(12) United States Patent
Goddard et al.

(10) Patent No.: US 7,115,415 B2
(45) Date of Patent: Oct. 3, 2006

(54) PRO9821 NUCLEIC ACIDS

(75) Inventors: Audrey Goddard, San Francisco, CA (US); Paul J. Godowski, Hillsborough, CA (US); Austin L. Gurney, Belmont, CA (US); Jean-Philippe F. Stephan, Millbrae, CA (US); Colin K. Watanabe, Moraga, CA (US); William I. Wood, Hillsborough, CA (US)

(73) Assignee: Genentech, Inc., South San Francisco, CA (US)

( * ) Notice: Subject to any disclaimer, the term of this patent is extended or adjusted under 35 U.S.C. 154(b) by 654 days.

(21) Appl. No.: 10/223,081

(22) Filed: Aug. 16, 2002

(65) Prior Publication Data

US 2003/0186866 A1 Oct. 2, 2003

Related U.S. Application Data

(63) Continuation of application No. 10/081,056, filed on Feb. 20, 2002, now abandoned, which is a continuation of application No. PCT/US01/21735, filed on Jul. 9, 2001, which is a continuation-in-part of application No. PCT/US01/19692, filed on Jun. 20, 2001.

(60) Provisional application No. 60/232,887, filed on Sep. 15, 2000.

(51) Int. Cl.
```
C12N 1/21    (2006.01)
C12N 1/15    (2006.01)
C12N 5/10    (2006.01)
C12N 15/12   (2006.01)
C12N 15/63   (2006.01)
```

(52) U.S. Cl. .............. 435/325; 435/69.1; 435/358; 435/252.3; 435/252.33; 435/254.11; 435/254.2; 435/320.1; 530/350; 536/23.1; 536/23.5

(58) Field of Classification Search .............. None
See application file for complete search history.

(56) References Cited

U.S. PATENT DOCUMENTS

2004/0048249 A1* 3/2004 Tang et al. ................ 435/6

FOREIGN PATENT DOCUMENTS

WO    WO 02/08284    1/2002

OTHER PUBLICATIONS

Skolnick et al. (2000). From genes to protein structure and function: novel applications of computational approaches in the genomic era. Trends in Biotech. 18(1):34-39.*
Bork, A. (2000). Powers and pitfalls in sequence analysis: the 70% hurdle. Genome Res. 10:398-400.*
Doerks et al. (1998). Protein annotation: detective work for function prediction. Trends in Genetics. 14(6):248-250.*
Smith et al. (1997). The challenges of genome sequence annotation or The devil is in the details. Nature Biotech. 15:1222-1223.*
Brenner, S.E. (1999). Errors in genome function. Trends in Genetics. 15(4):132-133.*
Bork et al. (1996). Go hunting in sequence databases but watch out for the traps. Trends in Genetics. 12(10):425-427.*
Wells, J.A. (1990). Additivity of mutational effects in proteins. Biochemistry. 29(37):8509-8517.*
Ngo et al. (1994). Computational complexity, protein structure prediction, and the Levinthal paradox. In Merz and Le Grand (Eds.) The Protein Folding Problem and Tertiary Structure Prediction. Birkhauser:Boston, pp. 492-495.*
Stratagene Product Catalog (1991). Prime-IT™ Random Primer Labeling Kit, Catalog # 300387.*
*Accession No. AC007394* (Waterston, R. H.), Creation Date Apr. 27, 1999.

* cited by examiner

*Primary Examiner*—Lorraine Spector
*Assistant Examiner*—Jon M. Lockard
(74) *Attorney, Agent, or Firm*—Elizabeth M. Barnes; Mark T. Kresnak; Ginger R. Dreger

(57) ABSTRACT

Compositions and methods are disclosed for stimulating or inhibiting angiogenesis and/or cardiovascularization in mammals, including humans. Pharmaceutical compositions are based on polypeptides or antagonists thereto that have been identified for one or more of these uses. Disorders that can be diagnosed, prevented, or treated by the compositions herein include trauma such as wounds, various cancers, and disorders of the vessels including atherosclerosis and cardiac hypertrophy. In addition, the present invention is directed to novel polypeptides and to nucleic acid molecules encoding those polypeptides. Also provided herein are vectors and host cells comprising those nucleic acid sequences, chimeric polypeptide molecules comprising the polypeptides of the present invention fused to heterologous polypeptide sequences, antibodies which bind to the polypeptides of the present invention and to methods for producing the polypeptides of the present invention.

19 Claims, 392 Drawing Sheets

FIGURE 1

GCCCACGCGTCCGATGGCGTTCACGTTCGCGGCCTTCTGCTACATGCTGGCGCTGCTGCT
CACTGCCGCGCTCATCTTCTTCGCCATTTGGCACATTATAGCATTTGATGAGCTGAAGAC
TGATTACAAGAATCCTATAGACCAGTGTAATACCCTGAATCCCCTTGTACTCCCAGAGTA
CCTCATCCACGCTTTCTTCTGTGTCATGTTTCTTTGTGCAGCAGAGTGGCTTACACTGGG
TCTCAATATGCCCCTCTTGGCATATCATATTTGGAGGTATATGAGTAGACCAGTGATGAG
TGGCCCAGGACTCTATGACCCTACAACCATCATGAATGCAGATATTCTAGCATATTGTCA
GAAGGAAGGATGGTGCAAATTAGCTTTTTATCTTCTAGCATTTTTTTACTACCTATATGG
CATGATCTATGTTTTGGTGAGCTCTTAGAACAACACACAGAAGAATTGGTCCAGTTAAGT
GCATGCAAAAAGCCACCAAATGAAGGGATTCTATCCAGCAAGATCCTGTCCAAGAGTAGC
CTGTGGAATCTGATCAGTTACTTTAAAAAATGACTCCTTATTTTTTAAATGTTTCCACAT
TTTTGCTTGTGGAAAGACTGTTTTCATATGTTATACTCAGATAAAGATTTTAAATGGTAT
TACGTATAAATTAATATAAAATGATTACCTCTGGTGTTGACAGGTTTGAACTTGCACTTC
TTAAGGAACAGCCATAATCCTCTGAATGATGCATTAATTACTGACTGTCCTAGTACATTG
GAAGCTTTTGTTTATAGGAACTTGTAGGGCTCATTTTGGTTTCATTGAAACAGTATCTAA
TTATAAATTAGCTGTAGATATCAGGTGCTTCTGATGAAGTGAAATGTATATCTGACTAG
TGGGAAACTTCATGGGTTTCCTCATCTGTCATGTCGATGATTATATGGATACATTTAC
AAAAATAAAAGCGGGAATTTTCCCTTCGCTTGAATATTATCCCTGTATATTGCATGAAT
GAGAGATTTCCCATATTTCCATCAGAGTAATAAATATACTTGCTTTAATTCTTAAGCATA
AGTAAACATGATATAAAAATATATGCTGAATTACTTGTGAAGAATGCATTTAAAGCTATT
TTAAATGTGTTTTTATTTGTAAGACATTACTTATTAAGAATTGGTTATTATGCTTACTG
TTCTAATCTGGTGGTAAAGGTATTCTTAAGAATTTGCAGGTACTACAGATTTTCAAAACT
GAATGAGAGAAAATTGTATAACCATCCTGCTGTTCCTTTAGTGCAATACAATAAAACTCT
GAAATTAAGACTC

FIGURE 2

MAFTFAAFCYMLALLLTAALIFFAIWHIIAFDELKTDYKNPIDQCNTLNPLVLPEYLIHA
FFCVMFLCAAEWLTLGLNMPLLAYHIWRYMSRPVMSGPGLYDPTTIMNADILAYCQKEGW
CKLAFYLLAFFYYLYGMIYVLVSS

Important features:
Signal peptide:
amino acids 1-20

Type II transmembrane domain:
amino acids 11-31

Other transmembrane domain:
amino acids 57-77 and 123-143

FIGURE 3

```
GGCTCAGAGGCCCCACTGGACCCTCGGCTCTTCCTTGGACTTCTTGTGTGTTCTGTGAGC
TTCGCTGGATTCAGGGTCTTGGGCATCAGAGGTGAGAGGGTGGGAAGGTCCGCCGCGATG
GGGAAGCCCTGGCTGCGTGCGCTACAGCTGCTGCTCCTGCTGGGCGCGTCGTGGGCGCGG
GCGGGCGCCCCGCGCTGCACCTACACCTTCGTGCTGCCCCCGCAGAAGTTCACGGGCGCT
GTGTGCTGGAGCGGCCCCGCATCCACGCGGGCGACGCCCGAGGCCGCCAACGCCAGCGAG
CTGGCGGCGCTGCGCATGCGCGTCGGCCGCCACGAGGAGCTGTTACGCGAGCTGCAGAGG
CTGGCGGCGGCCGACGGCGCCGTGGCCGGCGAGGTGCGCGCGCTGCGCAAGGAGAGCCGC
GGCCTGAGCGCGCGCCTGGGCCAGTTGCGCGCGCAGCTGCAGCACGAGGCGGGGCCCGGG
GCGGGCCCGGGGCGGATCTGGGGCGGAGCCTGCCGCGGCGCTGGCGCTGCTCGGGGAG
CGCGTGCTCAACGCGTCCGCCGAGGCTCAGCGCGCAGCCGCCCGGTTCCACCAGCTGGAC
GTCAAGTTCCGCGAGCTGGCGCAGCTCGTCACCCAGCAGAGCAGTCTCATCGCCCGCCTG
GAGCGCCTGTGCCCGGGAGGCGCGGGCGGGCAGCAGCAGGTCCTGCCGCCACCCCACTG
GTGCCTGTGGTTCCGGTCCGTCTTGTGGGTAGCACCAGTGACACCAGTAGGATGCTGGAC
CCAGCCCCAGAGCCCCAGAGAGACCAGACCCAGAGACAGCAGGAGCCCATGGCTTCTCCC
ATGCCTGCAGGTCACCCTGCGGTCCCCACCAAGCCTGTGGGCCCGTGGCAGGATTGTGCA
GAGGCCCGCCAGGCAGGCCATGAACAGAGTGGAGTGTATGAACTGCGAGTGGGCCGTCAC
GTAGTGTCAGTATGGTGTGAGCAGCAACTGGAGGGTGGAGGCTGGACTGTGATCCAGCGG
AGGCAAGATGGTTCAGTCAACTTCTTCACTACCTGGCAGCACTATAAGGCGGGCTTTGGG
CGGCCAGACGGAGAATACTGGCTGGGCCTTGAACCCGTGTATCAGCTGACCAGCCGTGGG
GACCATGAGCTGCTGGTTCTCCTGGAGGACTGGGGGGGCCGTGGAGCACGTGCCCACTAT
GATGGCTTCTCCCTGGAACCCGAGAGCGACCACTACCGCCTGCGGCTTGGCCAGTACCAT
GGTGATGCTGGAGACTCTCTTTCCTGGCACAATGACAAGCCCTTCAGCACCGTGGATAGG
GACCGAGACTCCTATTCTGGTAACTGTGCCCTGTACCAGCGGGGAGGCTGGTGGTACCAT
GCCTGTGCCCACTCCAACCTCAACGGTGTGTGGCACCACGGCGGCCACTACCGAAGCCGC
TACCAGGATGGTGTCTACTGGGCTGAGTTTCGTGGTGGGCATATTCTCTCAGGAAGGCC
GCCATGCTCATTCGGCCCCTGAAGCTGTGACTCTGTGTTCCTCTGTCCCCTAGGCCCTAG
AGGACATTGGTCAGCAGGAGCCCAAGTTGTTCTGGCCACACCTTCTTTGTGGCTCAGTGC
CAATGTGTCCCACAGAACTTCCCACTGTGGATCTGTGACCCTGGGCGCTGAAAATGGGAC
CCAGGAATCCCCCCGTCAATATCTTGGCCTCAGATGGCTCCCCAAGGTCATTCATATCT
CGGTTTGAGCTCATATCTTATAATAACACAAAGTAGCCAC
```

FIGURE 4

MGKPWLRALQLLLLLGASWARAGAPRCTYTFVLPPQKFTGAVCWSGPASTRATPEAANAS
ELAALRMRVGRHEELLRELQRLAAADGAVAGEVRALRKESRGLSARLGQLRAQLQHEAGP
GAGPGADLGAEPAAALALLGERVLNASAEAQRAAARFHQLDVKFRELAQLVTQQSSLIAR
LERLCPGGAGGQQQVLPPPPLVPVVPVRLVGSTSDTSRMLDPAPEPQRDQTQRQQEPMAS
PMPAGHPAVPTKPVGPWQDCAEARQAGHEQSGVYELRVGRHVVSVWCEQQLEGGGWTVIQ
RRQDGSVNFFTTWQHYKAGFGRPDGEYWLGLEPVYQLTSRGDHELLVLLEDWGGRGARAH
YDGFSLEPESDHYRLRLGQYHGDAGDSLSWHNDKPFSTVDRDRDSYSGNCALYQRGGWWY
HACAHSNLNGVWHHGGHYRSRYQDGVYWAEFRGGAYSLRKAAMLIRPLKL

Signal peptide:
Amino acids 1-20

N-glycosylation sites:
Amino acids 58-62;145-149 cAMP- and cGMP-dependent protein kinase phosphorylation
site:
Amino acids 97-101

Tyrosine kinase phosphorylation site:
Amino acids 441-448

N-myristoylation sites:
Amino acids
16-22;23-29;87-93;108-114;121-127;125-131;129-135;187-193;29
3-299;353-359;378-384;445-451;453-459

Cell attachment sequence:
Amino acids 340-343

Fibrinogen beta and gamma chains C-terminal domain
signature:
Amino acids 418-431

FIGURE 5

CCCACGCGTCCGGCGCCGTGGCCTCGCGTCCATCTTTGCCGTTCTCTCGGACCTGTCACA
AAGGAGTCGCGCCGCCGCCGCCGCCCCCTCCCTCCGGTGGGCCCGGGAGGTAGAGAAAGT
CAGTGCCACAGCCCGACCGCGCTGCTCTGAGCCCTGGGCACGCGGAACGGGAGGGAGTCT
GAGGGTTGGGGACGTCTGTGAGGAGGGGAACAGCCGCTCGAGCCTGGGGCGGGCGGACC
GGACTGGGGCCGGGGTAGGCTCTGGAAAGGGCCCGGGAGAGAGGTGGCGTTGGTCAGAAC
CTGAGAAACAGCCGAGAGGTTTTCCACCGAGGCCCGCGCTTGAGGGATCTGAAGAGGTTC
CTAGAAGAGGGTGTTCCCTCTTTCGGGGGTCCTCACCAGAAGAGGTTCTTGGGGGTCGCC
CTTCTGAGGAGGCTGCGGCTAACAGGGCCCAGAACTGCCATTGGATGTCCAGAATCCCCT
GTAGTTGATAATGTTGGGAATAAGCTCTGCAACTTTCTTTGGCATTCAGTTGTTAAAAAC
AAATAGGATGCAAATTCCTCAACTCCAGGTTATGAAAACAGTACTTGGAAAACTGAAAAC
TACCTAAATGATCGTCTTTGGTTGGGCCGTGTTCTTAGCGAGCAGAAGCCTTGGCCAGGG
TCTGTTGTTGACTCTCGAAGAGCACATAGCCCACTTCCTAGGGACTGGAGGTGCCGCTAC
TACCATGGGTAATTCCTGTATCTGCCGAGATGACAGTGGAACAGATGACAGTGTTGACAC
CCAACAGCAACAGGCCGAGAACAGTGCAGTACCCACTGCTGACACAAGGAGCCAACCACG
GGACCCTGTTCGGCCACCAAGGAGGGGCCGAGGACCTCATGAGCCAAGGAGAAAGAAACA
AAATGTGGATGGGCTAGTGTTGGACACACTGGCAGTAATACGGACTCTTGTAGATAAGTA
AGTATCTGACTCACGGTCACCTCCAGTGGAATGAAAAGTGTTCTGCCCGGAACCATGACT
TTAGGACTCCTTCAGTTCCTTTAGGACATACTCGCCAAGCCTTGTGCTCACAGGGCAAAG
GAGAATATTTTAATGCTCCGCTGATGGCAGAGTAAATGATAAGATTTGATGTTTTTGCTT
GCTGTCATCTACTTTGTCTGGAAATGTCTAAATGTTTCTGTAGCAGAAAACACGATAAAG
CTATGATCTTTATTAGAG

FIGURE 6

MIVFGWAVFLASRSLGQGLLLTLEEHIAHFLGTGGAATTMGNSCICRDDSGTDDSVDTQQ
QQAENSAVPTADTRSQPRDPVRPPRRGRGPHEPRRKKQNVDGLVLDTLAVIRTLVDKO

Signal peptide:
amino acids 1-16

Casein kinase II phosphorylation site:
amino acids 22-26, 50-54, 113-117

N-myristoylation site:
amino acids 18-24, 32-38, 34-40, 35-41, 51-57

FIGURE 7

CGGACGCGTGGGGGAAACCCTTCCGAGAAAACAGCAACAAGCTGAGCTGCTGTGACAGAG
GGGAACAAGATGGCGGCGCCGAAGGGGAGCCTCTGGGTGAGGACCCAACTGGGGCTCCCG
CCGCTGCTGCTGCTGACCATGGCCTTGGCCGGAGGTTCGGGGACCGCTTCGGCTGAAGCA
TTTGACTCGGTCTTGGGTGATACGGCGTCTTGCCACCGGGCCTGTCAGTTGACCTACCCC
TTGCACACCTACCCTAAGGAAGAGGAGTTGTACGCATGTCAGAGAGGTTGCAGGCTGTTT
TCAATTTGTCAGTTTGTGGATGATGGAATTGACTTAAATCGAACTAAATTGGAATGTGAA
TCTGCATGTACAGAAGCATATTCCAATCTGATGAGCAATATGCTTGCCATCTTGGTTGC
CAGAATCAGCTGCCATTCGCTGAACTGAGACAAGAACAACTTATGTCCCTGATGCCAAAA
ATGCACCTACTCTTTCCTCTAACTCTGGTGAGGTCATTCTGGAGTGACATGATGGACTCC
GCACAGAGCTTCATAACCTCTTCATGGACTTTTTATCTTCAAGCCGATGACGGAAAAATA
GTTATATTCCAGTCTAAGCCAGAAATCCAGTACGCACCACATTTGGAGCAGGAGCCTACA
AATTTGAGAGAATCATCTCTAAGCAAAATGTCCTATCTGCAAATGAGAAATTCACAAGCG
CACAGGAATTTTCTTGAAGATGGAGAAAGTGATGGCTTTTAAGATGCCTCTCTCTTAAC
TCTGGGTGGATTTTAACTACAACTCTTGTCCTCTCGGTGATGGTATTGCTTTGGATTTGT
TGTGCAACTGTTGCTACAGCTGTGGAGCAGTATGTTCCCTCTGAGAAGCTGAGTATCTAT
GGTGACTTGGAGTTTATGAATGAACAAAAGCTAAACAGATATCCAGCTTCTTCTCTTGTG
GTTGTTAGATCTAAAACTGAAGATCATGAAGAAGCAGGGCCTCTACCTACAAAAGTGAAT
CTTGCTCATTCTGAAATTTAAGCATTTTTCTTTTAAAAGACAAGTGTAATAGACATCTAA
AATTCCACTCCTCATAGAGCTTTTAAAATGGTTTCATTGGATATAGGCCTTAAGAAATCA
CTATAAAATGCAAATAAAGTTACTCAAATCTGTG

FIGURE 8

MAAPKGSLWVRTQLGLPPLLLLTMALAGGSGTASAEAFDSVLGDTASCHRACQLTYPLHT
YPKEEELYACQRGCRLFSICQFVDDGIDLNRTKLECESACTEAYSQSDEQYACHLGCQNQ
LPFAELRQEQLMSLMPKMHLLFPLTLVRSFWSDMMDSAQSFITSSWTFYLQADDGKIVIF
QSKPEIQYAPHLEQEPTNLRESSLSKMSYLQMRNSQAHRNFLEDGESDGFLRCLSLNSGW
ILTTTLVLSVMVLLWICCATVATAVEQYVPSEKLSIYGDLEFMNEQKLNRYPASSLVVVR
SKTEDHEEAGPLPTKVNLAHSEI

Important features:
Signal peptide:
amino acids 1-31

Transmembrane domain:
amino acids 241-260

N-glycosylation site:
amino acids 90-93

FIGURE 9

TATTTACCATATCAGATTCACATTCAGTCCTCAGCAAAATGAAGGGCTCCATTTTCACTC
TGTTTTTATTCTCTGTCCTATTTGCCATCTCAGAAGTGCGGAGCAAGGAGTCTGTGAGAC
TCTGTGGGCTAGAATACATACGGACAGTCATCTATATCTGTGCTAGCTCCAGGTGGAGAA
GGCATCTGGAGGGGATCCCTCAAGCTCAGCAAGCTGAGACAGGAAACTCCTTCCAGCTCC
CACATAAACGTGAGTTTTCTGAGGAAAATCCAGCGCAAAACCTTCCGAAGGTGGATGCCT
CAGGGGAAGACCGTCTTTGGGGTGGACAGATGCCCACTGAAGAGCTTTGGAAGTCAAAGA
AGCATTCAGTGATGTCAAGACAAGATTTACAAACTTTGTGTTGCACTGATGGCTGTTCCA
TGACTGATTTGAGTGCTCTTTGCTAAGACAAGAGCAAATACCCAATGGGTGGCAGAGCTT
TATCACATGTTTAATTACAGTGTTTTACTGCCTGGTAGAACACTAATATTGTGTTATTAA
AATGATGGCTTTTGGGTAGGCAAAACTTCTTTTCTAAAAGGTATAGCTGAGCGGTTGAAA
CCACAGTGATCTCTATTTTCTCCCTTTGCCAAGGTTAATGAACTGTTCTTTTCAAATTCT
ACTAATGCTTTGAAATTTCAAATGCTGCGCAAAATTGCAATAAAAATGCTATAAA

FIGURE 10

MKGSIFTLFLFSVLFAISEVRSKESVRLCGLEYIRTVIYICASSRWRRHLEGIPQAQQAE
TGNSFQLPHKREFSEENPAQNLPKVDASGEDRLWGGQMPTEELWKSKKHSVMSRQDLQTL
CCTDGCSMTDLSALC

Important features:
Signal sequence:
amino acids 1-18 cAMP- and cGMP-dependent protein kinase phosphorylation site:
amino acids 107-111

N-myristoylation sites:
amino acids 3-9,52-58,96-102,125-131

Insulin family signature:
amino acids 121-136

Insulin family proteins:
amino acids 28-46

FIGURE 11

CCCACGCGTCCGGACAAACTGGAGGTGAAAGGAGCTGGTACTGTCCACTGTGCTGTCGGT
GCTGAACCTGAGACGCGAGCGGACCAGTTGCTCCAGCACCTGAAGGCAACGCCCTCTTGC
ACCCTCTGTGCCCTGTGGGACCCGCTTCACCAACAGGACCCATATCAACTTGACAAAGGA
GTGTGGTATCGGACGTGGGAGAGAGTCCTCTGTTTGCCACCTGGGCGCTCATTCAGGCGT
GACTTTGGAGATTTCTATAGTTTTAGACCAAACTATTTTTTTTCCCCAGCTAAGACGAT
CTTTTGAGAGTTTTTTTTTTTATTGTGATTTATATTTCCACAGCGTTTAGGAATCTTTCT
GGGGGACTTTTGTGACTGTTAAAATAAGGTGAAAAGCAATAAGG<ins>ATG</ins>TTTAAGTGCTGGT
CAGTTGTCTTGGTTCTCGGATTCATTTTTCTGGAGTCGGAAGGAAGGCCAACCAAAGAAG
GAGGATATGGCCTTAAATCCTATCAGCCTCTAATGAGATTGCGACATAAGCAGGAAAAAA
ATCAAGAAAGTTCAAGAGTCAAAGGATTTATGATTCAGGATGGCCCTTTTGGATCTTGTG
AAAATAAGTACTGTGGTTTGGGAAGACACTGTGTTACCAGCAGAGAGACAGGGCAAGCAG
AATGTGCCTGTATGGACTTTGCAAACGTCACTACAAACCTGTGTGTGGATCTGACGGAG
AATTCTATGAAAACCACTGTGAAGTGCACAGAGCTGCTTGCCTGAAAAAACAAAAGATTA
CCATTGTTCACAATGAAGACTGCTTCTTTAAAGGAGATAAGTGCAAGACTACTGAATACA
GCAAGATGAAAAATATGCTATTAGATTTACAAAATCAAAATATATTATGCAAGAAAATG
AAAATCCTAATGGCGACGACATATCTCGGAAGAAGCTATTGGTGGATCAAATGTTTAAAT
ATTTTGATGCAGACAGTAATGGACTTGTAGATATTAATGAACTAACTCAGGTGATAAAAC
AGGAAGAACTTGGCAAGGATCTCTTTGATTGTACTTTGTATGTTCTATTGAAATATGATG
ATTTTAATGCTGACAAGCACCTGGCTCTTGAAGAATTTTATAGAGCATTCCAAGTGATCC
AGTTGAGTCTGCCAGAAGATCAGAAACTAAGCATCACTGCAGCAACTGTGGGACAAAGTG
CTGTTCTGAGCTGTGCCATTCAAGGAACCCTGAGACCTCCCATTATCTGGAAAAGGAACA
ATATTATTCTAAATAATTTAGATTTGGAAGACATCAATGACTTTGGAGATGATGGGTCCT
TGTATATTACTAAGGTTACCACAACTCACGTTGGCAATTACACCTGCTATGCAGATGGCT
ATGAACAAGTCTATCAGACTCACATCTTCCAAGTGAATGTTCCTCCAGTCATCC

FIGURE 12

MFKCWSVVLVLGFIFLESEGRPTKEGGYGLKSYQPLMRLRHKQEKNQESSRVKGFMIQDG
PFGSCENKYCGLGRHCVTSRETGQAECACMDLCKRHYKPVCGSDGEFYENHCEVHRAACL
KKQKITIVHNEDCFFKGDKCKTTEYSKMKNMLLDLQNQKYIMQENENPNGDDISRKKLLV
DQMFKYFDADSNGLVDINELTQVIKQEELGKDLFDCTLYVLLKYDDFNADKHLALEEFYR
AFQVIQLSLPEDQKLSITAATVGQSAVLSCAIQGTLRPPIIWKRNNIILNNLDLEDINDF
GDDGSLYITKVTTTHVGNYTCYADGYEQVYQTHIFQVNVPPVI

Signal sequence:
Amino acids 1-20

N-glycosylation site:
Amino acids 318-322

Tyrosine kinase phosphorylation sites:
Amino acids 21-29;211-220

N-myristoylation sites:
Amino acids 63-69;83-89;317-323

Prokaryotic membrane lipoprotein lipid attachment site:
Amino acids 260-271

FIGURE 13

```
TGCCGGGCTGCGGGGCGCCTTGACTCTCCCTCCACCCTGCCTCCTCGGGCTCCACTCGTC
TGCCCCTGGACTCCCGTCTCCTCCTGTCCTCCGGCTTCCCAGAGCTCCCTCCTTATGGCA
GCAGCTTCCCGCGTCTCCGGCGCAGCTTCTCAGCGGACGACCCTCTCGCTCCGGGGCTGA
GCCCAGTCCCTGGATGTTGCTGAAACTCTCGAGATCATGCGCGGGTTTGGCTGCTGCTTC
CCCGCCGGGTGCCACTGCCACCGCCGCCGCCTCTGCTGCCGCCGTCCGCGGGATGCTCAG
TAGCCCGCTGCCCGGCCCCCGCGATCCTGTGTTCCTCGGAAGCCGTTTGCTGCTGCAGAG
TTGCACGAACTAGTCATGGTGCTGTGGGAGTCCCCGCGGCAGTGCAGCAGCTGGACACTT
TGCGAGGGCTTTTGCTGGCTGCTGCTGCCCGTCATGCTACTCATCGTAGCCCGCCCG
GTGAAGCTCGCTGCTTTCCCTACCTCCTTAAGTGACTGCCAAACGCCCACCGGCTGGAAT
TGCTCTGGTTATGATGACAGAGAAAATGATCTCTTCCTCTGTGACACCAACACCTGTAAA
TTTGATGGGGAATGTTTAAGAATTGGAGACACTGTGACTTGCGTCTGTCAGTTCAAGTGC
AACAATGACTATGTGCCTGTGTGTGGCTCCAATGGGGAGAGCTACCAGAATGAGTGTTAC
CTGCGACAGGCTGCATGCAAACAGCAGAGTGAGATACTTGTGGTGTCAGAAGGATCATGT
GCCACAGATGCAGGATCAGGATCTGGAGATGGAGTCCATGAAGGCTCTGGAGAAACTAGT
CAAAAGGAGACATCCACCTGTGATATTTGCCAGTTTGGTGCAGAATGTGACGAAGATGCC
GAGGATGTCTGGTGTGTGTAATATTGACTGTTCTCAAACCAACTTCAATCCCCTCTGC
GCTTCTGATGGGAAATCTTATGATAATGCATGCCAAATCAAAGAAGCATCGTGTCAGAAA
CAGGAGAAAATTGAAGTCATGTCTTTGGGTCGATGTCAAGATAACACAACTACAACTACT
AAGTCTGAAGATGGGCATTATGCAAGAACAGATTATGCAGAGAATGCTAACAAATTAGAA
GAAAGTGCCAGAGAACACCACATACCTTGTCCGGAACATTACAATGGCTTCTGCATGCAT
GGGAAGTGTGAGCATTCTATCAATATGCAGGAGCCATCTTGCAGGTGTGATGCTGGTTAT
ACTGGACAACACTGTGAAAAAAGGACTACAGTGTTCTATACGTTGTTCCCGGTCCTGTA
CGATTTCAGTATGTCTTAATCGCAGCTGTGATTGGAACAATTCAGATTGCTGTCATCTGT
GTGGTGGTCCTCTGCATCACAAGGAAATGCCCCAGAAGCAACAGAATTCACAGACAGAAG
CAAAATACAGGGCACTACAGTTCAGACAATACAACAAGAGCGTCCACGAGGTTAATCTAA
AGGGAGCATGTTTCACAGTGGCTGGACTACCGAGAGCTTGGACTACACAATACAGTATTA
TAGACAAAAGAATAAGACAAGAGATCTACACATGTTGCCTTGCATTTGTGGTAATCTACA
CCAATGAAAACATGTACTACAGCTATATTTGATTATGTATGGATATATTTGAAATAGTAT
ACATTGTCTTGATGTTTTTTCTGTAATGTAAATAAACTATTTATATCACACAATATAGTT
TTTTCTTTCCCATGTATTTGTTATATATAATAAATACTCAGTGATGAG
```

FIGURE 14

MVLWESPRQCSSWTLCEGFCWLLLLPVMLLIVARPVKLAAFPTSLSDCQTPTGWNCSGY
DDRENDLFLCDTNTCKFDGECLRIGDTVTCVCQFKCNNDYVPVCGSNGESYQNECYLRQ
AACKQQSEILVVSEGSCATDAGSGSGDGVHEGSGETSQKETSTCDICQFGAECDEDAED
VWCVCNIDCSQTNFNPLCASDGKSYDNACQIKEASCQKQEKIEVMSLGRCQDNTTTTTK
SEDGHYARTDYAENANKLEESAREHHIPCPEHYNGFCMHGKCEHSINMQEPSCRCDAGY
TGQHCEKKDYSVLYVVPGPVRFQYVLIAAVIGTIQIAVICVVVLCITRKCPRSNRIHRQ
KQNTGHYSSDNTTRASTRLI

FIGURE 15

GGAGCTCAGCCCAGTGGGCAGTCTGAAGATGGCCAATTACACGCTGGCACCAGAGGATGA
ATATGATGTCCTCATAGAAGGTGAACTGGAGAGCGATGAGGCAGAGCAATGTGACAAGTA
TGACGCCCAGGCACTCTCAGCCCAGCTGGTGCCATCACTCTGCTCTGCTGTGTTTGTGAT
CGGTGTCCTGGACAATCTCCTGGTTGTGCTTATCCTGGTAAAATATAAAGGACTCAAACG
CGTGGAAAATATCTATCTTCTAAACTTGGCAGTTTCTAACTTGTGTTTCTTGCTTACCCT
GCCCTTCTGGGCTCATGCTGGGGGCGATCCCATGTGTAAAATTCTCATTGGACTGTACTT
CGTGGGCCTGTACAGTGAGACATTTTTCAATTGCCTTCTGACTGTGCAAAGGTACCTAGT
GTTTTTGCACAAGGGCAACTTTTTCTCAGCCAGGAGGAGGGTGCCCTGTGGCATCATTAC
AAGTGTCCTGGCATGGGTAACAGCCATTCTGGCCACTTTGCCTGAATACGTGGTTTATAA
ACCTCAGATGGAAGACCAGAAATACAAGTGTGCATTTAGCAGAACTCCCTTCCTGCCAGC
TGATGAGACATTCTGGAAGCATTTTCTGACTTTAAAAATGAACATTTCGGTTCTTGTCCT
CCCCCTATTTATTTTTACATTTCTCTATGTGCAAATGAGAAAAACACTAAGGTTCAGGGA
GCAGAGGTATAGCCTTTTCAAGCTTGTTTTTGCCATAATGGTAGTCTTCCTTCTGATGTG
GGCGCCCTACAATATTGCATTTTTCCTGTCCACTTTCAAAGAACACTTCTCCCTGAGTGA
CTGCAAGAGCAGCTACAATCTGGACAAAAGTGTTCACATCACTAAACTCATCGCCACCAC
CCACTGCTGCATCAACCCTCTCCTGTATGCGTTTCTTGATGGACATTTAGCAAATACCT
CTGCCGCTGTTTCCATCTGCGTAGTAACACCCCACTTCAACCCAGGGGGCAGTCTGCACA
AGGCACATCGAGGGAAGAACCTGACCATTCCACCGAAGTGTAAACTAGCATCCACCAAAT
GCAAGAAGAATAAACATGGATTTTCATCTTTCTGCATTATTTCATGTAAATTTTCTACAC
ATTTGTATACAAAATCGGATACAGGAAGAAAAGGGAGAGGTGAGCTAACATTTGCTAAGC
ACTGAATTTGTCTCAGGCACCGTGCAAGGCTCTTTACAAACGTGAGCTCCTTCGCCTCCT
ACCACTTGTCCATAGTGTGGATAGGACTAGTCTCATTTCTCTGAGAAGAAAACTAAGGCG
CGGAAATTTGTCTAAGATCACATAACTAGGAAGTGGCAGAACTGATTCTCCAGCCCTGGT
AGCATTTGCTCAGAGCCTACGCTTGGTCCAGAACATCAAACTCCAAACCCTGGGGACAAA
CGACATGAAATAAATGTATTTTAAAACATCTAAAA

FIGURE 16

MANYTLAPEDEYDVLIEGELESDEAEQCDKYDAQALSAQLVPSLCSAVFVIGVLDNLLVV
LILVKYKGLKRVENIYLLNLAVSNLCFLLTLPFWAHAGGDPMCKILIGLYFVGLYSETFF
NCLLTVQRYLVFLHKGNFFSARRRVPCGIITSVLAWVTAILATLPEYVVYKPQMEDQKYK
CAFSRTPFLPADETFWKHFLTLKMNISVLVLPLFIFTFLYVQMRKTLRFREQRYSLFKLV
FAIMVVFLLMWAPYNIAFFLSTFKEHFSLSDCKSSYNLDKSVHITKLIATTHCCINPLLY
AFLDGTFSKYLCRCFHLRSNTPLQPRGQSAQGTSREEPDHSTEV

Signal sequence:
None

Transmembrane domain:
41-61, 76-96, 109-129, 147-167, 199-219, 237-257, 285-305

7 transmembrane receptor (rhodopsin family):
55-300

N-glycosylation site:
3-6, 205-208

Tyrosine kinase phosphorylation site:
70-76, 171-179, 228-234

N-myristoylation site:
52-57, 136-141, 148-153

G-protein coupled receptors:
55-85, 96-136, 209-220, 235-254, 292-308

FIGURE 17

```
CGGACGCGTGGGCGGACGCGTGGGCGGCCCACGGCGCCCGCGGGCTGGGGCGGTCGCTTC
TTCCTTCTCCGTGGCCTACGAGGGTCCCCAGCCTGGGTAAAGATGGCCCCATGGCCCCCG
AAGGGCCTAGTCCCAGCTGTGCTCTGGGGCCTCAGCCTCTTCCTCAACCTCCCAGGACCT
ATCTGGCTCCAGCCCTCTCCACCTCCCCAGTCTTCTCCCCGCCTCAGCCCCATCCGTGT
CATACCTGCCGGGGACTGGTTGACAGCTTTAACAAGGGCCTGGAGAGAACCATCCGGGAC
AACTTTGGAGGTGGAAACACTGCCTGGGAGGAAGAGAATTTGTCCAAATACAAAGACAGT
GAGACCCGCCTGGTAGAGGTGCTGGAGGGTGTGTGCAGCAAGTCAGACTTCGAGTGCCAC
CGCCTGCTGGAGCTGAGTGAGGAGCTGGTGGAGAGCTGGTGGTTTCACAAGCAGCAGGAG
GCCCCGGACCTCTTCCAGTGGCTGTGCTCAGATTCCCTGAAGCTCTGCTGCCCCGCAGGC
ACCTTCGGGCCCTCCTGCCTTCCCTGTCCTGGGGAACAGAGAGGCCCTGCGGTGGCTAC
GGGCAGTGTGAAGGAGAAGGGACACGAGGGGGCAGCGGGCACTGTGACTGCCAAGCCGGC
TACGGGGGTGAGGCCTGTGGCCAGTGTGGCCTTGGCTACTTTGAGGCAGAACGCAACGCC
AGCCATCTGGTATGTTCGGCTTGTTTTGGCCCCTGTGCCCGATGCTCAGGACCTGAGGAA
TCAAACTGTTTGCAATGCAAGAAGGGCTGGGCCCTGCATCACCTCAAGTGTGTAGACATT
GATGAGTGTGGCACAGAGGGAGCCAACTGTGGAGCTGACCAATTCTGCGTGAACACTGAG
GGCTCCTATGAGTGCCGAGACTGTGCCAAGGCCTGCCTAGGCTGCATGGGGCAGGGCCA
GGTCGCTGTAAGAAGTGTAGCCCTGGCTATCAGCAGGTGGGCTCCAAGTGTCTCGATGTG
GATGAGTGTGAGACAGAGGTGTGTCCGGGAGAGAACAAGCAGTGTGAAAACACCGAGGGC
GGTTATCGCTGCATCTGTGCCGAGGGCTACAAGCAGATGGAAGGCATCTGTGTGAAGGAG
CAGATCCCAGAGTCAGCAGGCTTCTTCTCAGAGATGACAGAAGACGAGTTGGTGGTGCTG
CAGCAGATGTTCTTTGGCATCATCATCTGTGCACTGGCCACGCTGGCTGCTAAGGGCGAC
TTGGTGTTCACCGCCATCTTCATTGGGCTGTGGCGGCCATGACTGGCTACTGGTTGTCA
GAGCGCAGTGACCGTGTGCTGGAGGGCTTCATCAAGGGCAGATAATCGCGGCCACCACCT
GTAGGACCTCCTCCCACCCACGCTGCCCCAGAGCTTGGGCTGCCCTCCTGCTGGACACT
CAGGACAGCTTGGTTTATTTTTGAGAGTGGGGTAAGCACCCCTACCTGCCTTACAGAGCA
GCCCAGGTACCCAGGCCCGGGCAGACAAGGCCCTGGGGTAAAAAGTAGCCCTGAAGGTG
GATACCATGAGCTCTTCACCTGGCGGGACTGGCAGGCTTCACAATGTGTGAATTTCAAA
AGTTTTTCCTTAATGGTGGCTGCTAGAGCTTTGGCCCCTGCTTAGGATTAGGTGGTCCTC
ACAGGGGTGGGGCCATCACAGCTCCCTCCTGCCAGCTGCATGCTGCCAGTTCCTGTTCTG
TGTTCACCACATCCCCACACCCCATTGCCACTTATTTATTCATCTCAGGAAATAAAGAAA
GGTCTTGGAAAGTTAAAAAAAAAAAAAAAAAAAAAAA
```

FIGURE 18

MAPWPPKGLVPAVLWGLSLFLNLPGPIWLQPSPPPQSSPPPQPHPCHTCRGLVDSFNKGL
ERTIRDNFGGGNTAWEEENLSKYKDSETRLVEVLEGVCSKSDFECHRLLELSEELVESWW
FHKQQEAPDLFQWLCSDSLKLCCPAGTFGPSCLPCPGGTERPCGGYGQCEGEGTRGGSGH
CDCQAGYGGEACGQCGLGYFEAERNASHLVCSACFGPCARCSGPEESNCLQCKKGWALHH
LKCVDIDECGTEGANCGADQFCVNTEGSYECRDCAKACLGCMGAGPGRCKKCSPGYQQVG
SKCLDVDECETEVCPGENKQCENTEGGYRCICAEGYKQMEGICVKEQIPESAGFFSEMTE
DELVVLQQMFFGIIICALATLAAKGDLVFTAIFIGAVAAMTGYWLSERSDRVLEGFIKGR

FIGURE 19

```
GCCCGGGACTGGCGCAAGGTGCCCAAGCAAGGAAAGAAATAATGAAGAGACACATGTGTT
AGCTGCAGCCTTTTGAAACACGCAAGAAGGAAATCAATAGTGTGGACAGGGCTGGAACCT
TTACCACGCTTGTTGGAGTAGATGAGGAATGGGCTCGTGATTATGCTGACATTCCAGCAT
GAATCTGGTAGACCTGTGGTTAACCCGTTCCCTCTCCATGTGTCTCCTCCTACAAAGTTT
TGTTCTTATGATACTGTGCTTTCATTCTGCCAGTATGTGTCCCAAGGGCTGTCTTTGTTC
TTCCTCTGGGGGTTTAAATGTCACCTGTAGCAATGCAAATCTCAAGGAAATACCTAGAGA
TCTTCCTCCTGAAACAGTCTTACTGTATCTGGACTCCAATCAGATCACATCTATTCCCAA
TGAAATTTTTAAGGACCTCCATCAACTGAGAGTTCTCAACCTGTCCAAAAATGGCATTGA
GTTTATCGATGAGCATGCCTTCAAAGGAGTAGCTGAAACCTTGCAGACTCTGGACTTGTC
CGACAATCGGATTCAAAGTGTGCACAAAAATGCCTTCAATAACCTGAAGGCCAGGGCCAG
AATTGCCAACAACCCCTGGCACTGCGACTGTACTCTACAGCAAGTTCTGAGGAGCATGGC
GTCCAATCATGAGACAGCCCACAACGTGATCTGTAAAACGTCCGTGTTGGATGAACATGC
TGGCAGACCATTCCTCAATGCTGCCAACGACGCTGACCTTTGTAACCTCCCTAAAAAAAC
TACCGATTATGCCATGCTGGTCACCATGTTTGGCTGGTTCACTATGGTGATCTCATATGT
GGTATATTATGTGAGGCAAAATCAGGAGGATGCCCGGAGACACCTCGAATACTTGAAATC
CCTGCCAAGCAGGCAGAAGAAAGCAGATGAACCTGATGATATTAGCACTGTGGTATAGTG
TCCAAACTGACTGTCATTGAGAAAGAAAGAAAGTAGTTTGCGATTGCAGTAGAAATAAGT
GGTTTACTTCTCCCATCCATTGTAAACATTTGAAACTTTGTATTTCAGTTTTTTTTGAAT
TATGCCACTGCTGAACTTTTAACAAACACTACAACATAAATAATTTGAGTTTAGGTGATC
CACCCCTTAATTGTACCCCCGATGGTATATTTCTGAGTAAGCTACTATCTGAACATTAGT
TAGATCCATCTCACTATTTAATAATGAAATTTATTTTTTAATTTAAAAGCAAATAAAAG
CTTAACTTTGAACCATGGGAAAAAAAAAAAAAAAAAAAAAACA
```

FIGURE 20

MNLVDLWLTRSLSMCLLLQSFVLMILCFHSASMCPKGCLCSSSGGLNVTCSNANLKEIPR
DLPPETVLLYLDSNQITSIPNEIFKDLHQLRVLNLSKNGIEFIDEHAFKGVAETLQTLDL
SDNRIQSVHKNAFNNLKARARIANNPWHCDCTLQQVLRSMASNHETAHNVICKTSVLDEH
AGRPFLNAANDADLCNLPKKTTDYAMLVTMFGWFTMVISYVVYYVRQNQEDARRHLEYLK
SLPSRQKKADEPDDISTVV

Signal sequence:
amino acids 1-33

Transmembrane domain:
amino acids 205-220

N-glycosylation site:
amino acids 47-51, 94-98 cAMP- and cGMP-dependent protein kinase phosphorylation site:
amino acids 199-203

Casein kinase II phosphorylation site:
amino acids 162-166, 175-179

N-myristoylation site:
amino acids 37-43, 45-51, 110-116

FIGURE 21

```
CGCCACCACTGCGGCCACCGCCAATGAAACGCCTCCCGCTCCTAGTGGTTTTTTCCACTT
TGTTGAATTGTTCCTATACTCAAAATTGCACCAAGACACCTTGTCTCCCAAATGCAAAAT
GTGAAATACGCAATGGAATTGAAGCCTGCTATTGCAACATGGGATTTTCAGGAAATGGTG
TCACAATTTGTGAAGATGATAATGAATGTGGAAATTTAACTCAGTCCTGTGGCGAAAATG
CTAATTGCACTAACACAGAAGGAAGTTATTATTGTATGTGTACCTGGCTTCAGATCCA
GCAGTAACCAAGACAGGTTTATCACTAATGATGGAACCGTCTGTATAGAAATGTGAATG
CAAACTGCCATTTAGATAATGTCTGTATAGCTGCAAATATTAATAAAACTTTAACAAAAA
TCAGATCCATAAAAGAACCTGTGGCTTTGCTACAAGAAGTCTATAGAAATTCTGTGACAG
ATCTTTCACCAACAGATATAATTACATATATAGAAATATTAGCTGAATCATCTTCATTAC
TAGGTTACAAGAACAACACTATCTCAGCCAAGGACACCCTTTCTAACTCAACTCTTACTG
AATTTGTAAAAACCGTGAATAATTTTGTTCAAAGGGATACATTTGTAGTTTGGGACAAGT
TATCTGTGAATCATAGGAGAACACATCTTACAAAACTCATGCACACTGTTGAACAAGCTA
CTTTAAGGATATCCCAGAGCTTCCAAAAGACCACAGAGTTTGATACAAATTCAACGGATA
TAGCTCTCAAAGTTTTCTTTTTTGATTCATATAACATGAAACATATTCATCCTCATATGA
ATATGGATGGAGACTACATAAATATATTTCCAAAGAGAAAAGCTGCATATGATTCAAATG
GCAATGTTGCAGTTGCATTTTTATATTATAAGAGTATTGGTCCTTTGCTTTCATCATCTG
ACAACTTCTTATTGAAACCTCAAAATTATGATAATTCTGAAGAGGAGGAAAGAGTCATAT
CTTCAGTAATTTCAGTCTCAATGAGCTCAAACCCACCCACATTATATGAACTTGAAAAAA
TAACATTTACATTAAGTCATCGAAAGGTCACAGATAGGTATAGGAGTCTATGTGCATTTT
GGAATTACTCACCTGATACCATGAATGGCAGCTGGTCTTCAGAGGGCTGTGAGCTGACAT
ACTCAAATGAGACCCACACCTCATGCCGCTGTAATCACCTGACACATTTTGCAATTTTGA
TGTCCTCTGGTCCTTCCATTGGTATTAAAGATTATAATATTCTTACAAGGATCACTCAAC
TAGGAATAATTATTTCACTGATTTGTCTTGCCATATGCATTTTTACCTTCTGGTTCTTCA
GTGAAATTCAAAGCACCAGGACAACAATTCACAAAAATCTTTGCTGTAGCCTATTTCTTG
CTGAACTTGTTTTTCTTGTTGGGATCAATACAAATACTAATAAGCTCTTCTGTTCAATCA
TTGCCGGACTGCTACACTACTTCTTTTTAGCTGCTTTTGCATGGATGTGCATTGAAGGCA
TACATCTCTATCTCATTGTTGTGGGTGTCATCTACAACAAGGGATTTTGCACAAGAATT
TTTATATCTTTGGCTATCTAAGCCCAGCCGTGGTAGTTGGATTTTCGGCAGCACTAGGAT
ACAGATATTATGGCACAACCAAAGTATGTTGGCTTAGCACCGAAAACAACTTTATTTGGA
GTTTTATAGGACCAGCATGCCTAATCATTCTTGTTAATCTCTTGGCTTTTGGAGTCATCA
TATACAAAGTTTTTCGTCACACTGCAGGGTTGAAACCAGAAGTTAGTTGCTTTGAGAACA
TAAGGTCTTGTGCAAGAGGAGCCCTCGCTCTTCTGTTCCTTCTCGGCACCACCTGGATCT
TTGGGGTTCTCCATGTTGTGCACGCATCAGTGGTTACAGCTTACCTCTTCACAGTCAGCA
ATGCTTTCCAGGGGATGTTCATTTTTTTATTCCTGTGTGTTTTATCTAGAAAGATTCAAG
AAGAATATTACAGATTGTTCAAAATGTCCCTGTTGTTTGGATGTTTAAGGTAAACAT
AGAGAATGGTGGATAATTACAACTGCACAAAATAAAAATTCCAAGCTGTGGATGACCAA
TGTATAAAAATGACTCATCAAATTATCCAATTATTAACTACTAGACAAAAGTATTTTAA
ATCAGTTTTTCTGTTTATGCTATAGGAACTGTAGATAATAAGGTAAAATTATGTATCATA
TAGATATACTATGTTTTTCTATGTGAAATAGTTCTGTCAAAAATAGTATTGCAGATATTT
GGAAAGTAATTGGTTTCTCAGGAGTGATATCACTGCACCCAAGGAAAGATTTTCTTTCTA
ACACGAGAAGTATATGAATGTCCTGAAGGAAACCACTGGCTTGATATTTCTGTGACTCGT
GTTGCCTTTGAAACTAGTCCCTACCACCTCGGTAATGAGCTCCATTACAGAAAGTGGAA
CATAAGAGAATGAAGGGGCAGAATATCAAACAGTGAAAGGGAATGATAAGATGTATTTT
GAATGAACTGTTTTTTCTGTAGACTAGCTGAGAAATTGTTGACATAAAATAAAGAATTGA
AGAAACACATTTTACCATTTTGTGAATTGTTCTGAACTTAAATGTCCACTAAAACAACTT
AGACTTCTGTTTGCTAAATCTGTTTCTTTTTCTAATATTCTAAAAAAAAAAAAAAGGTTT
ACCTCCACAAATTGAAAAAAAAAAAAAAAAAAAAAAAAAAAAAAAAAAAAAAAAAAAAAA
```

FIGURE 22

MKRLPLLVVFSTLLNCSYTQNCTKTPCLPNAKCEIRNGIEACYCNMGFSGNGVTICEDDN
ECGNLTQSCGENANCTNTEGSYYCMCVPGFRSSSNQDRFITNDGTVCIENVNANCHLDNV
CIAANINKTLTKIRSIKEPVALLQEVYRNSVTDLSPTDIITYIEILAESSSLLGYKNNTI
SAKDTLSNSTLTEFVKTVNNFVQRDTFVVWDKLSVNHRRTHLTKLMHTVEQATLRISQSF
QKTTEFDTNSTDIALKVFFFDSYNMKHIHPHMNMDGDYINIFPKRKAAYDSNGNVAVAFL
YYKSIGPLLSSSDNFLLKPQNYDNSEEEERVISSVISVSMSSNPPTLYELEKITFTLSHR
KVTDRYRSLCAFWNYSPDTMNGSWSSEGCELTYSNETHTSCRCNHLTHFAILMSSGPSIG
IKDYNILTRITQLGIIISLICLAICIFTFWFFSEIQSTRTTIHKNLCCSLFLAELVFLVG
INTNTNKLFCSIIAGLLHYFFLAAFAWMCIEGIHLYLIVVGVIYNKGFLHKNFYIFGYLS
PAVVVGFSAALGYRYYGTTKVCWLSTENNFIWSFIGPACLIILVNLLAFGVIIYKVFRHT
AGLKPEVSCFENIRSCARGALALLFLLGTTWIFGVLHVVHASVVTAYLFTVSNAFQGMFI
FLFLCVLSRKIQEEYYRLFKNVPCCFGCLR

FIGURE 23

CTCCTCTTAACATACTTGCAGCTAAAACTAAATATTGCTGCTTGGGGACCTCCTTCTAGC
CTTAAATTTCAGCTCATCACCTTCACCTGCCTTGGTC<u>ATG</u>GCTCTGCTATTCTCCTTGAT
CCTTGCCATTTGCACCAGACCTGGATTCCTAGCGTCTCCATCTGGAGTGCGGCTGGTGGG
GGGCCTCCACCGCTGTGAAGGGCGGGTGGAGGTGGAACAGAAAGGCCAGTGGGGCACCGT
GTGTGATGACGGCTGGGACATTAAGGACGTGGCTGTGTTGTGCCGGGAGCTGGGCTGTGG
AGCTGCCAGCGGAACCCCTAGTGGTATTTTGTATGAGCCACCAGCAGAAAAGAGCAAAA
GGTCCTCATCCAATCAGTCAGTTGCACAGGAACAGAAGATACATTGGCTCAGTGTGAGCA
AGAAGAAGTTTATGATTGTTCACATGATGAAGATGCTGGGGCATCGTGTGAGAACCCAGA
GAGCTCTTTCTCCCCAGTCCCAGAGGGTGTCAGGCTGGCTGACGGCCCTGGGCATTGCAA
GGGACGCGTGGAAGTGAAGCACCAGAACCAGTGGTATACCGTGTGCCAGACAGGCTGGAG
CCTCCGGGCCGCAAAGGTGGTGTGCCGGCAGCTGGGATGTGGGAGGGCTGTACTGACTCA
AAAACGCTGCAACAAGCATGCCTATGGCCGAAAACCCATCTGGCTGAGCCAGATGTCATG
CTCAGGACGAGAAGCAACCCTTCAGGATTGCCCTTCTGGGCCTTGGGGAAGAACACCTG
CAACCATGATGAAGACACGTGGGTCGAATGTGAAGATCCCTTTGACTTGAGACTAGTAGG
AGGAGACAACCTCTGCTCTGGGCGACTGGAGGTGCTGCACAAGGGCGTATGGGGCTCTGT
CTGTGATGACAACTGGGGAGAAAAGGAGGACCAGGTGGTATGCAAGCAACTGGGCTGTGG
GAAGTCCCTCTCCCTCCTTCAGAGACCGGAAATGCTATGGCCCTGGGGTTGGCCGCAT
CTGGCTGGATAATGTTCGTTGCTCAGGGGAGGAGCAGTCCCTGGAGCAGTGCCAGCACAG
ATTTTGGGGGTTTCACGACTGCACCCACCAGGAAGATGTGGCTGTCATCTGCTCAGTG<u>TA</u>
<u>G</u>GTGGGCATCATCTAATCTGTTGAGTGCCTGAATAGAAGAAAAACACAGAAGAAGGGAGC
ATTTACTGTCTACATGACTGCATGGGATGAACACTGATCTTCTTCTGCCCTTGGACTGGG
ACTTATACTTGGTGCCCCTGATTCTCAGGCCTTCAGAGTTGGATCAGAACTTACAACATC
AGGTCTAGTTCTCAGGCCATCAGACATAGTTTGGAACTACATCACCACCTTTCCTATGTC
TCCACATTGCACACAGCAGATTCCCAGCCTCCATAATTGTGTGTATCAACTACTTAAATA
CATTCTCACACACACACACACACACACACACACACACACATACACCATTTGTCC
TGTTTCTCTGAAGAACTCTGACAAAATACAGATTTTGGTACTGAAAGAGATTCTAGAGGA
ACGGAATTTTAAGGATAAATTTTCTGAATTGGTTATGGGGTTTCTGAAATTGGCTCTATA
ATCTAATTAGATATAAATTCTGGTAACTTTATTTACAATAATAAAGATAGCACTATGTG
TTCAAA

FIGURE 24

MALLFSLILAICTRPGFLASPSGVRLVGGLHRCEGRVEVEQKGQWGTVCDDGWDIKDVAV
LCRELGCGAASGTPSGILYEPPAEKEQKVLIQSVSCTGTEDTLAQCEQEEVYDCSHDEDA
GASCENPESSFSPVPEGVRLADGPGHCKGRVEVKHQNQWYTVCQTGWSLRAAKVVCRQLG
CGRAVLTQKRCNKHAYGRKPIWLSQMSCSGREATLQDCPSGPWGKNTCNHDEDTWVECED
PFDLRLVGGDNLCSGRLEVLHKGVWGSVCDDNWGEKEDQVVCKQLGCGKSLSPSFRDRKC
YGPGVGRIWLDNVRCSGEEQSLEQCQHRFWGFHDCTHQEDVAVICSV

Signal sequence:
amino acids 1-15

Casein kinase II phosphorylation site:
amino acids 47-51, 97-101, 115-119, 209-213, 214-218, 234-238,
267-271, 294-298, 316-320, 336-340

N-myristoylation site:
amino acids 29-35, 43-49, 66-72, 68-74, 72-78, 98-104, 137-143,
180-186, 263-269, 286-292

Amidation site:
amino acids 196-200

Speract receptor repeated domain signature:
amino acids 29-67, 249-287

FIGURE 25

```
CGGACGCGTGGGCGTCCGGCGGTCGCAGAGCCAGGAGGCGGAGGCGCGCGGGCCAGCCTG
GGCCCCAGCCCACACCTTCACCAGGGCCCAGGAGCCACCATGTGGCGATGTCCACTGGGG
CTACTGCTGTTGCTGCCGCTGGCTGGCCACTTGGCTCTGGGTGCCCAGCAGGGTCGTGGG
CGCCGGGAGCTAGCACCGGGTCTGCACCTGCGGGGCATCCGGGACGCGGGAGGCCGGTAC
TGCCAGGAGCAGGACCTGTGCTGCCGCGGCCGTGCCGACGACTGTGCCCTGCCCTACCTG
GGCGCCATCTGTTACTGTGACCTCTTCTGCAACCGCACGGTCTCCGACTGCTGCCCTGAC
TTCTGGGACTTCTGCCTCGGCGTGCCACCCCCTTTTCCCCGATCCAAGGATGTATGCAT
GGAGGTCGTATCTATCCAGTCTTGGGAACGTACTGGGACAACTGTAACCGTTGCACCTGC
CAGGAGAACAGGCAGTGGCATGGTGGATCCAGACATGATCAAAGCCATCAACCAGGGCAA
CTATGGCTGGCAGGCTGGGAACCACAGCGCCTTCTGGGGCATGACCCTGGATGAGGGCAT
TCGCTACCGCCTGGGCACCATCCGCCCATCTTCCTCGGTCATGAACATGCATGAAATTTA
TACAGTGCTGAACCCAGGGGAGGTGCTTCCACAGCCTTCGAGGCCTCTGAGAAGTGGCC
CAACCTGATTCATGAGCCTCTTGACCAAGGCAACTGTGCAGGCTCCTGGGCCTTCTCCAC
AGCAGCTGTGGCATCCGATCGTGTCTCAATCCATTCTCTGGGACACATGACGCCTGTCCT
GTCGCCCCAGAACCTGCTGTCTTGTGACACCCACCAGCAGCAGGGCTGCCGCGGTGGGCG
TCTCGATGGTGCCTGGTGGTTCCTGCGTCGCCGAGGGGTGGTGTCTGACCACTGCTACCC
CTTCTCGGGCCGTGAACGAGACGAGGCTGGCCCTGCGCCCCCTGTATGATGCACAGCCG
AGCCATGGGTCGGGCAAGCGCCAGGCCACTGCCCACTGCCCCAACAGCTATGTTAATAA
CAATGACATCTACCAGGTCACTCCTGTCTACCGCCTCGGCTCCAACGACAAGGAGATCAT
GAAGGAGCTGATGGAGAATGGCCCTGTCCAAGCCCTCATGGAGGTGCATGAGGACTTCTT
CCTATACAAGGGAGGCATCTACAGCCACACGCCAGTGAGCCTTGGGAGGCCAGAGAGATA
CCGCCGGCATGGGACCCACTCAGTCAAGATCACAGGATGGGGAGAGGAGACGCTGCCAGA
TGGAAGGACGCTCAAATACTGGACTGCGGCCAACTCCTGGGGCCCAGCCTGGGGCGAGAG
GGGCCACTTCCGCATCGTGCGCGGCGTCAATGAGTGCGACATCGAGAGCTTCGTGCTGGG
CGTCTGGGGCCGCGTGGGCATGGAGGACATGGGTCATCACTGAGGCTGCGGGCACCACGC
GGGGTCCGGCCTGGGATCCAGGCTAAGGGCCGGCGGAAGAGGCCCCAATGGGCGGTGAC
CCCAGCCTCGCCCGACAGAGCCCGGGGCGCAGGCGGGCGCCAGGGCGCTAATCCCGGCGC
GGGTTCCGCTGACGCAGCGCCCCGCCTGGGAGCCGCGGGCAGGCGAGACTGGCGGAGCCC
CCAGACCTCCCAGTGGGGACGGGGCAGGGCCTGGCCTGGGAAGAGCACAGCTGCAGATCC
CAGGCCTCTGGCGCCCCACTCAAGACTACCAAAGCCAGGACACCTCAAGTCTCCAGCCC
CAATACCCCACCCCAATCCCGTATTCTTTTTTTTTTTTTTAGACAGGGTCTTGCTCCG
TTGCCCAGGTTGGAGTGCAGTGGCCCATCAGGGCTCACTGTAACCTCCGACTCCTGGGTT
CAAGTGACCCTCCCACCTCAGCCTCTCAAGTAGCTGGGACTACAGGTGCACCACCACACC
TGGCTAATTTTTGTATTTTTTGTAAAGAGGGGGGTCTCACTGTGTTGCCCAGGCTGGTTT
CGAACTCCTGGGCTCAAGCGGTCCACCTGCCTCCGCCTCCCAAAGTGCTGGGATTGCAGG
CATGAGCCACTGCACCCAGCCCTGTATTCTTATTCTTCAGATATTTATTTTTCTTTTCAC
TGTTTTAAAATAAAACCAAAGTATTGATAAAAAAAA
```

FIGURE 26

MWRCPLGLLLLLPLAGHLALGAQQGRGRRELAPGLHLRGIRDAGGRYCQEQDLCCRGRAD
DCALPYLGAICYCDLFCNRTVSDCCPDFWDFCLGVPPPFPPIQGCMHGGRIYPVLGTYWD
NCNRCTCQENRQWHGGSRHDQSHQPGQLWLAGWEPQRLLGHDPG

N-glycosylation site:
amino acids 78-82, 161-165

Casein kinase II phosphorylation site:
amino acids 80-84, 117-121, 126-130, 169-173, 205-209, 296-300,
411-415

N-myristoylation site:
amino acids 21-27, 39-45, 44-50, 104-110, 160-164, 224-230,
269-275, 378-384, 442-448

Amidation site:
amino acids 26-30, 318-322

Eukaryotic thiol (cysteine) proteases histidine active site:
amino acids 398-409

FIGURE 27

```
CCCACGCGTCCGGCAGGTTTTTCTTCAAGCCAAGAAGGACACGGATTGGCTGAAGGAGAA
AGTGCAGAGCTTGCAGACACTGGCTGCCAACAACTCTGCGTTGGCCAAAGCCAACAACGA
CACCCTGGAGGATATGAACAGCCAGCTCAACTCATTCACAGGTCAGATGGAGAACATCAC
CACTATCTCTCAAGCCAACGAGCAGAACCTGAAAGACCTGCAGGACTTACACAAAGATGC
AGAGAATAGAACAGCCATCAAGTTCAACCAACTGGAGGAACGCTTCCAGCTCTTTGAGAC
GGATATTGTGAACATCATTAGCAATATCAGTTACACAGCCCACCACCTGCGGACGCTGAC
CAGCAATCTAAATGAAGTCAGGACCACTTGCACAGATACCTTACCAAACACACAGATGAT
CTGACCTCCTTGAATAATACCCTGGCCAACATCCGTTTGGATTCTGTTTCTCTCAGGATG
CAACAAGATTTGATGAGGTCGAGGTTAGACACTGAAGTAGCCAACTTATCAGTGATTATG
GAAGAAATGAAGCTAGTAGACTCCAAGCATGGTCAGCTCATCAAGAATTTTACAATACTA
CAAGGTCCACCGGGCCCCAGGGGTCCAAGAGGTGACAGAGGATCCCAGGGACCCCCTGGC
CCAACTGGCAACAAGGGACAGAAAGGAGAGAAGGGGGAGCCTGGACCACCTGGCCCTGCG
GGTGAGAGAGGCCCAATTGGACCAGCTGGTCCCCCCGGAGAGCGTGGCGGCAAAGGATCT
AAAGGCTCCCAGGGCCCCAAAGGCTCCCGTGGTTCCCCTGGGAAGCCCGGCCCTCAGGGC
CCCAGTGGGGACCCAGGCCCCCCGGGCCCACCAGGCAAAGAGGGACTCCCCGGCCCTCAG
GGCCCTCCTGGCTTCCAGGGACTTCAGGGCACCGTTGGGGAGCCTGGGGTGCCTGGACCT
CGGGGACTGCCAGGCTTGCCTGGGGTACCAGGCATGCCAGGCCCCAAGGGCCCCCCCGGC
CCTCCTGGCCCATCAGGAGCGGTGGTGCCCCTGGCCCTGCAGAATGAGCCAACCCCGGCA
CCGGAGGACAATAGCTGCCCGCCTCACTGGAAGAACTTCACAGACAAATGCTACTATTTT
TCAGTTGAGAAAGAAATTTTTGAGGATGCAAAGCTTTTCTGTGAAGACAAGTCTTCACAT
CTTGTTTTCATAAACACTAGAGAGGAACAGCAATGGATAAAAAAACAGATGGTAGGGAGA
GAGAGCCACTGGATCGGCCTCACAGACTCAGAGCGTGAAAATGAATGGAAGTGGCTGGAT
GGGACATCTCCAGACTACAAAAATTGGAAAGCTGGACAGCCGGATAACTGGGGTCATGGC
CATGGGCCAGGAGAAGACTGTGCTGGGTTGATTTATGCTGGGCAGTGGAACGATTTCCAA
TGTGAAGACGTCAATAACTTCATTTGCGAAAAGACAGGGAGACAGTACTGTCATCTGCA
TTATAACGGACTGTGATGGGATCACATGAGCAAATTTTCAGCTCTCAAAGGCAAAGGACA
CTCCTTTCTAATTGCATCACCTTCTCATCAGATTGAAAAAAAAAAGCACTGAAAACCAA
TTACTGAAAAAAAATTGACAGCTAGTGTTTTTACCATCCGTCATTACCCAAAGACTTGG
GAACTAAAATGTTCCCCAGGGTGATATGCTGATTTTCATTGTGCACATGGACTGAATCAC
ATAGATTCTCCTCCGTCAGTAACCGTGCGATTATACAAATTATGTCTTCCAAAGTATGGA
ACACTCCAATCAGAAAAGGTTATCATTGGTCGTTGAGTTATGGGAAGAACTTAAGCATA
TACTGTGTAAACAGTGCCATACATTTCTAAAATCCCAAGTGTAGGAAAAATATGCAGACA
TACAGATATATAGGCCAACTATTAGTAATAATATGAAATATACTTAAAGAGCTTTTAAAA
CTTTGTATTTTTGTACAAAAAAAA
```

FIGURE 28

```
MQQDLMRSRLDTEVANLSVIMEEMKLVDSKHGQLIKNFTILQGPPGPRGPRGDRGSQGPP
GPTGNKGQKGEKGEPGPPGPAGERGPIGPAGPPGERGGKGSKGSQGPKGSRGSPGKPGPQ
GPSGDPGPPGPPGKEGLPGPQGPPGFQGLQGTVGEPGVPGPRGLPGLPGVPGMPGPKGPP
GPPGPSGAVVPLALQNEPTPAPEDNSCPPHWKNFTDKCYYFSVEKEIFEDAKLFCEDKSS
HLVFINTREEQQWIKKQMVGRESHWIGLTDSERENEWKWLDGTSPDYKNWKAGQPDNWGH
GHGPGEDCAGLIYAGQWNDFQCEDVNNFICEKDRETVLSSAL
```

Signal sequence:
None

Transmembrane domain:
None

N-glycosylation site:
16-19, 37-40, 213-216

Tyrosine kinase phosphorylation site:
212-220

N-myristoylation site:
97-102, 100-105, 148-153, 267-272, 293-298, 310-315

Cell attachment sequence:
51-53

C-type lectin domain signature:
308-330

Lectin C-type domain:
233-330

Collagen triple helix repeat:
43-102, 127-186

FIGURE 29

```
GGACTAATCTGTGGGAGCAGTTTATTCCAGTATCACCCAGGGTGCAGCCACACCAGGACT
GTGTTGAAGGGTGTTTTTTTTCTTTTAAATGTAATACCTCCTCATCTTTTCTTCTTACAC
AGTGTCTGAGAACATTTACATTATAGATAAGTAGTACATGGTGGATAACTTCTACTTTTA
GGAGGACTACTCTCTTCTGACAGTCCTAGACTGGTCTTCTACACTAAGACACCATGAAGG
AGTATGTGCTCCTATTATTCCTGGCTTTGTGCTCTGCCAAACCCTTCTTTAGCCCTTCAC
ACATCGCACTGAAGAATATGATGCTGAAGGATATGGAAGACACAGATGATGATGATGATG
ATGATGATGATGATGATGATGAGGACAACTCTCTTTTTCCAACAAGAGAGCCAAGAA
GCCATTTTTTTCCATTTGATCTGTTTCCAATGTGTCCATTTGGATGTCAGTGCTATTCAC
GAGTTGTACATTGCTCAGATTTAGGTTTGACCTCAGTCCCAACCAACATTCCATTTGATA
CTCGAATGCTTGATCTTCAAAACAATAAAATTAAGGAAATCAAAGAAATGATTTAAAG
GACTCACTTCACTTTATGGTCTGATCCTGAACAACAACAAGCTAACGAAGATTCACCCAA
AAGCCTTTCTAACCACAAAGAAGTTGCGAAGGCTGTATCTGTCCCACAATCAACTAAGTG
AAATACCACTTAATCTTCCCAAATCATTAGCAGAACTCAGAATTCATGAAAATAAAGTTA
AGAAAATACAAAAGGACACATTCAAAGGAATGAATGCTTTACACGTTTTGGAAATGAGTG
CAAACCCTCTTGATAATAATGGGATAGAGCCAGGGGCATTTGAAGGGGTGACGGTGTTCC
ATATCAGAATTGCAGAAGCAAAACTGACCTCAGTTCCTAAAGGCTTACCACCAACTTTAT
TGGAGCTTCACTTAGATTATAATAAAATTTCAACAGTGGAACTTGAGGATTTTAAACGAT
ACAAAGAACTACAAAGGCTGGGCCTAGGAAACAACAAAATCACAGATATCGAAATGGGA
GTCTTGCTAACATACCACGTGTGAGAGAAATACATTTGGAAAACAATAAACTAAAAAAAA
TCCCTTCAGGATTACCAGAGTTGAAATACCTCCAGATAATCTTCCTTCATTCTAATTCAA
TTGCAAGAGTGGGAGTAAATGACTTCTGTCCAACAGTGCCAAAGATGAAGAAATCTTTAT
ACAGTGCAATAAGTTTATTCAACAACCCGGTGAAATACTGGGAAATGCAACCTGCAACAT
TTCGTTGTGTTTTGAGCAGAATGAGTGTTCAGCTTGGGAACTTTGGAATGTAATAATTAG
TAATTGGTAATGTCCATTTAATATAAGATTCAAAAATCCCTACATTTGGAATACTTGAAC
TCTATTAATAATGGTAGTATTATATATACAAGCAAATATCTATTCTCAAGTGGTAAGTCC
ACTGACTTATTTTATGACAAGAAATTTCAACGGAATTTTGCCAAACTATTGATACATAAG
GGGTTGAGAGAAACAAGCATCTATTGCAGTTTCCTTTTTGCGTACAAATGATCTTACATA
AATCTCATGCTTGACCATTCCTTTCTTCATAACAAAAAGTAAGATATTCGGTATTTAAC
ACTTTGTTATCAAGCACATTTTAAAAGAACTGTACTGTAAATGGAATGCTTGACTTAGC
AAAATTTGTGCTCTTTCATTTGCTGTTAGAAAAACAGAATTAACAAAGACAGTAATGTGA
AGAGTGCATTACACTATTCTTATTCTTTAGTAACTTGGGTAGTACTGTAATATTTTAAT
CATCTTAAAGTATGATTTGATATAATCTTATTGAAATTACCTTATCATGTCTTAGAGCCC
GTCTTTATGTTTAAAACTAATTTCTTAAAATAAAGCCTTCAGTAAATGTTCATTACCAAC
TTGATAAATGCTACTCATAAGAGCTGGTTTGGGGCTATAGCATATGCTTTTTTTTTTTA
ATTATTACCTGATTTAAAAATCTCTGTAAAAACGTGTAGTGTTTCATAAAATCTGTAACT
CGCATTTTAATGATCCGCTATTATAAGCTTTTAATAGCATGAAAATTGTTAGGCTATATA
ACATTGCCACTTCAACTCTAAGGAATATTTTGAGATATCCCTTTGGAAGACCTTGCTTG
GAAGAGCCTGGACACTAACAATTCTACACCAAATTGTCTCTTCAAATACGTATGGACTGG
ATAACTCTGAGAAACACATCTAGTATAACTGAATAAGCAGAGCATCAAATTAAACAGACA
GAAACCGAAAGCTCTATATAAATGCTCAGAGTTCTTTATGTATTTCTTATTGGCATTCAA
CATATGTAAAATCAGAAAACAGGGAAATTTTCATTAAAAATATTGGTTTGAAAT
```

FIGURE 30

MKEYVLLLFLALCSAKPFFSPSHIALKNMMLKDMEDTDDDDDDDDDDDDEDNSLFPTRE
PRSHFFPFDLFPMCPFGCQCYSRVVHCSDLGLTSVPTNIPFDTRMLDLQNNKIKEIKEND
FKGLTSLYGLILNNNKLTKIHPKAFLTTKKLRRLYLSHNQLSEIPLNLPKSLAELRIHEN
KVKKIQKDTFKGMNALHVLEMSANPLDNNGIEPGAFEGVTVFHIRIAEAKLTSVPKGLPP
TLLELHLDYNKISTVELEDFKRYKELQRLGLGNNKITDIENGSLANIPRVREIHLENNKL
KKIPSGLPELKYLQIIFLHSNSIARVGVNDFCPTVPKMKKSLYSAISLFNNPVKYWEMQP
ATFRCVLSRMSVQLGNFGM

Signal sequence:
amino acids 1-15

N-glycosylation site:
amino acids 281-285

N-myristoylation sites:
amino acids 129-135, 210-216, 214-220, 237-243, 270-276, 282-288

Leucine zipper pattern:
amino acids 154-176

FIGURE 31

```
AGCAGGGAAATCCGGATGTCTCGGTTATGAAGTGGAGCAGTGAGTGTGAGCCTCAACATA
GTTCCAGAACTCTCCATCCGGACTAGTTATTGAGCATCTGCCTCTCATATCACCAGTGGC
CATCTGAGGTGTTTCCCTGGCTCTGAAGGGGTAGGCACGATGGCCAGGTGCTTCAGCCTG
GTGTTGCTTCTCACTTCCATCTGGACCACGAGGCTCCTGGTCCAAGGCTCTTTGCGTGCA
GAAGAGCTTTCCATCCAGGTGTCATGCAGAATTATGGGGATCACCCTTGTGAGCAAAAAG
GCGAACCAGCAGCTGAATTTCACAGAAGCTAAGGAGGCCTGTAGGCTGCTGGGACTAAGT
TTGGCCGGCAAGGACCAAGTTGAAACAGCCTTGAAAGCTAGCTTTGAAACTTGCAGCTAT
GGCTGGGTTGGAGATGGATTCGTGGTCATCTCTAGGATTAGCCCAAACCCCAAGTGTGGG
AAAAATGGGGTGGGTGTCCTGATTTGGAAGGTTCCAGTGAGCCGACAGTTTGCAGCCTAT
TGTTACAACTCATCTGATACTTGGACTAACTCGTGCATTCCAGAAATTATCACCACCAAA
GATCCCATATTCAACACTCAAACTGCAACACAAACAACAGAATTTATTGTCAGTGACAGT
ACCTACTCGGTGGCATCCCCTTACTCTACAATACCTGCCCCTACTACTACTCCTCCTGCT
CCAGCTTCCACTTCTATTCCACGGAGAAAAAATTGATTTGTGTCACAGAAGTTTTTATG
GAAACTAGCACCATGTCTACAGAAACTGAACCATTTGTTGAAAATAAAGCAGCATTCAAG
AATGAAGCTGCTGGGTTTGGAGGTGTCCCCACGGCTCTGCTAGTGCTTGCTCTCCTCTTC
TTTGGTGCTGCAGCTGGTCTTGGATTTTGCTATGTCAAAAGGTATGTGAAGGCCTTCCCT
TTTACAAACAAGAATCAGCAGAAGGAAATGATCGAAACCAAAGTAGTAAAGGAGGAGAAG
GCCAATGATAGCAACCCTAATGAGGAATCAAAGAAAACTGATAAAAACCCAGAAGAGTCC
AAGAGTCCAAGCAAAACTACCGTGCGATGCCTGGAAGCTGAAGTTTAGATGAGACAGAAA
TGAGGAGACACACCTGAGGCTGGTTTCTTTCATGCTCCTTACCCTGCCCCAGCTGGGGAA
ATCAAAAGGGCCAAAGAACCAAAGAAGAAAGTCCACCCTTGGTTCCTAACTGGAATCAGC
TCAGGACTGCCATTGGACTATGGAGTGCACCAAAGAGAATGCCCTTCTCCTTATTGTAAC
CCTGTCTGGATCCTATCCTCCTACCTCCAAAGCTTCCCACGGCCTTTCTAGCCTGGCTAT
GTCCTAATAATATCCCACTGGGAGAAAGGAGTTTTGCAAAGTGCAAGGACCTAAAACATC
TCATCAGTATCCAGTGGTAAAAAGGCCTCCTGGCTGTCTGAGGCTAGGTGGGTTGAAAGC
CAAGGAGTCACTGAGACCAAGGCTTTCTCTACTGATTCCGCAGCTCAGACCCTTTCTTCA
GCTCTGAAAGAGAAACACGTATCCCACCTGACATGTCCTTCTGAGCCCGGTAAGAGCAAA
AGAATGGCAGAAAAGTTTAGCCCCTGAAAGCCATGGAGATTCTCATAACTTGAGACCTAA
TCTCTGTAAAGCTAAAATAAAGAAATAGAACAAGGCTGAGGATACGACAGTACACTGTCA
GCAGGGACTGTAAACACAGACAGGGTCAAAGTGTTTTCTCTGAACACATTGAGTTGGAAT
CACTGTTTAGAACACACACTTACTTTTTCTGGTCTCTACCACTGCTGATATTTTCTCT
AGGAAATATACTTTTACAAGTAACAAAATAAAACTCTTATAAATTTCTATTTTTATCT
GAGTTACAGAAATGATTACTAAGGAAGATTACTCAGTAATTTGTTTAAAAAGTAATAAAA
TTCAACAAACATTTGCTGAATAGCTACTATATGTCAAGTGCTGTGCAAGGTATTACACTC
TGTAATTGAATATTATTCCTCAAAAAATTGCACATAGTAGAACGCTATCTGGGAAGCTAT
TTTTTTCAGTTTTGATATTTCTAGCTTATCTACTTCCAAACTAATTTTTATTTTGCTGA
GACTAATCTTATTCATTTTCTCTAATATGGCAACCATTATAACCTTAATTTATTATTAAC
ATACCTAAGAAGTACATTGTTACCTCTATATACCAAAGCACATTTTAAAAGTGCCATTAA
CAAATGTATCACTAGCCCTCCTTTTTCCAACAAGAAGGGACTGAGAGATGCAGAAATATT
TGTGACAAAAAATTAAAGCATTTAGAAAACTT
```

FIGURE 32

MARCFSLVLLLTSIWTTRLLVQGSLRAEELSIQVSCRIMGITLVSKKANQQLNFTEAKEA
CRLLGLSLAGKDQVETALKASFETCSYGWVGDGFVVISRISPNPKCGKNGVGVLIWKVPV
SRQFAAYCYNSSDTWTNSCIPEIITTKDPIFNTQTATQTTEFIVSDSTYSVASPYSTIPA
PTTTPPAPASTSIPRRKKLICVTEVFMETSTMSTETEPFVENKAAFKNEAAGFGGVPTAL
LVLALLFFGAAAGLGFCYVKRYVKAFPFTNKNQQKEMIETKVVKEEKANDSNPNEESKKT
DKNPEESKSPSKTTVRCLEAEV

Signal sequence:
amino acids 1-16

Transmembrane domain:
amino acids 235-254

N-glycosylation site:
amino acids 53-57, 130-134, 289-293

Casein kinase II phosphorylation site:
amino acids 145-149, 214-218

Tyrosine kinase phosphorylation site:
amino acids 79-88

N-myristoylation site:
amino acids 23-29, 65-71, 234-240, 235-239, 249-255, 253-259

FIGURE 33

```
GAAAAAAAAAAAAGGGAAGCAAGCTTAGCTGTACACCCTGAGTCTTGCAAAAGCTGCAG
CCCCACCCAGGAGCAGGGTGGTGGCTGGGGCGATGGTGGACGCCCTGAAGATGTCCATG
GCTACTGAAGGGGCTGCCCAGTTAGGGAACAGAGTGGCGGGCATGGTGTGTAGCCTATGG
GTGCTGCTCCTGGTGTCTTCAGTTCTGGCTCTGGAAGAGGTATTGCTGGACACCACCGGA
GAGACATCTGAGATTGGCTGGCTCACCTACCCACCAGGGGGGTGGGACGAGGTGAGTGTT
CTGGACGACCAGCGACGCCTGACTCGGACCTTTGAGGCATGTCATGTGGCAGGGGCCCCT
CCAGGCACCGGGCAGGACAATTGGTTGCAGACACACTTTGTGGAGCGGCGCGGGCCCAG
AGGGCGCACATTCGACTCCACTTCTCTGTGCGGGCATGCTCCAGCCTGGGTGTGAGCGGC
GGCACCTGCCGGGAGACCTTCACCCTTTACTACCGTCAGGCTGAGGAGCCCGACAGCCCT
GACAGCGTTTCCTCCTGGCACCTCAAACGTTGGACCAAGGTGGACACAATTGCAGCAGAC
GAGAGCTTTCCATCCTCCTCCTCCTCCTCCTCCTCTTCTTCCTCTGCAGCGTGGGCT
GTGGGACCCCACGGGGCTGGGCAGCGGGCTGGACTGCAACTGAACGTCAAAGAGCGGAGC
TTTGGGCCTCTCACCCAACGCGGCTTCTACGTGGCCTTCCAGGACACGGGGGCCTGCCTG
GCCCTGGTCGCTGTCAGGCTCTTCTCCTACACCTGCCCTGCCGTGCTCCGATCCTTTGCT
TCCTTTCCAGAGACGCAGGCCAGTGGGGCTGGGGGGGCCTCCCTGGTGGCAGCTGTGGGC
ACCTGTGTGGCTCATGCAGAGCCAGAGGAGGATGGAGTAGGGGGCCAGGCAGGAGGCAGC
CCCCCCAGGCTGCACTGCAACGGGGAGGGCAAGTGGATGGTAGCTGTCGGGGCTGCCGC
TGCCAGCCTGGATACCAACCAGCACGAGGAGACAAGGCCTGCCAAGCCTGCCCACGGGGG
CTCTATAAGGCTTCTGCTGGGAATGCTCCCTGCTCACCATGCCCTGCCCGCAGTCACGCT
CCCAACCCAGCAGCCCCGTTTGCCCCTGCCTGGAGGGCTTCTACCGGGCCAGTTCCGAC
CCACCAGAGGCCCCCTGCACTGGTCCTCCATCGGCTCCCCAGGAGCTTTGGTTTGAGGTG
CAAGGCTCAGCACTCATGCTACACTGGCGCCTGCCTCGGGAGCTGGGGGGTCGAGGGGAC
CTGCTCTTCAATGTCGTGTGCAAGGAGTGTGAAGGCCGCCAGGAACCTGCCAGCGGTGGT
GGGGGCACTTGTCACCGCTGCAGGGATGAGGTCCACTTCGACCCTCGCCAGAGAGGCCTG
ACTGAGAGCCGAGTGTTAGTGGGGGGACTCCGGGCACACGTACCCTACATCTTAGAGGTG
CAGGCTGTTAATGGGGTGTCTGAGCTCAGCCCTGACCCTCCTCAGGCTGCAGCCATCAAT
GTCAGCACCAGCCATGAAGTGCCCTCTGCTGTCCCTGTGGTGCACCAGGTGAGCCGGGCA
TCCAACAGCATCACGGTGTCCTGGCCGCAGCCCGACCAGACCAATGGGAACATCCTGGAC
TATCAGCTCCGCTACTATGACCAGGCAGAAGACGAATCCCACTCCTTCACCCTGACCAGC
GAGACCAACACTGCCACCGTGACACAGCTGAGCCCTGGCCACATCTATGGTTTCCAGGTG
CGGGCCCGGACTGCTGCCGGCCACGGCCCCTACGGGGGCAAAGTCTATTTCCAGACACTT
CCTCAAGGGGAGCTGTCTTCCCAGCTTCCGGAAAGACTCTCCTTGGTGATCGGCTCCACC
CTGGGGGCTTTGGCCTTCCTCCTGCTGGCAGCCATCACCGTGCTGGCGGTCGTCTTCCAG
CGGAAGCGGCGTGGGACTGGCTACACGGAGCAGCTGCAGCAATACAGCAGCCAGGACTC
GGGGTGAAGTATTACATCGACCCCTCCACCTACGAGGACCCCTGTCAGGCCATCCGAGAA
CTTGCCCGGGAAGTCGATCCTGCTTATATCAAGATTGAGGAGGTCATTGGGACAGGCTCT
TTTGGAGAAGTGCGCCAGGGCCGCCTGCAGCCACGGGGACGGAGGGAGCAGACTGTGGCC
ATCCAGGCCCTGTGGGCCGGGGCGCCGAAAGCCTGCAGATGACCTTCCTGGGCCGGGCC
GCAGTGCTGGGTCAGTTCCAGCACCCCAACATCCTGCGGCTGGAGGGCGTGGTCACCAAG
AGCCGACCCCTCATGGTGCTGACGGAGTTCATGGAGCTTGGCCCCCTGGACAGCTTCCTC
AGGCAGCGGGAGGGCCAGTTCAGCAGCCTGCAGCTGGTGGCCATGCAGCGGGAGTGGCT
GCTGCCATGCAGTACCTGTCCAGCTTTGCCTTCGTCCATCGCTCGCTGTCTGCCCACAGC
GTGCTGGTGAATAGCCACTTGGTGTGCAAGGTGGCCCGTCTTGGCCACAGTCCTCAGGGC
CCAAGTTGTTTGCTTCGCTGGGCAGCCCCAGAGGTCATTGCACATGGAAAGCATACTCAT
GTGGGAAGTGATGAGTTATGGAGAACGGCCTTACTGGGACATGAGTGACAGGAGGTACT
AAATGCAATAGAGCAGGAGTTCCGGCTGCCCCGCCTCCAGGCTGTCCTCCTGGATTACA
```

FIGURE 33
(continued)

```
TCTACTTATGTTGGACACTTGGCAGAAGGACCGTGCCCGGCGGCCTCATTTTGACCAGCT
GGTGGCTGCATTTGACAAGATGATCCGCAAGCCAGATACCCTGCAGGCTGGCGGGGACCC
AGGGGAAAGGCCTTCCCAGGCCCTTCTGACCCCTGTGGCCCTGGACTTTCCTTGTCTGGA
CTCACCCCAGGCCTGGCTTTCAGCCATTGGACTGGAGTGCTACCAGGACAACTTCTCCAA
GTTTGGCCTCTGTACCTTCAGTGATGTGGCTCAGCTCAGCCTAGAAGACCTGCCTGCCCT
GGGCATCACCCTGGCTGGCCACCAGAAGAAGCTGCTGCACCACATCCAGCTCCTTCAGCA
ACACCTGAGGCAGCAGGGCTCAGTGGAGGTCTGAGAATGACGATACCCGTGACTCAGCCC
TGGACACTGGTCCGAGAAGGGACATGTGGGACGTGAGCCGGGCTCCAACAGCCTCTGTGA
GAGATGCCCCACACCAAACCCAACCCTCCGATGGCTGCATTCCCTGGTCCTCCGCTTTTC
CACCAGCCCCCTCCTCATTAAAGGGAAAGAAGGGAATTTGCAAAAAAAAAAAAAAAAAA
AAAAAAA
```

FIGURE 34

MATEGAAQLGNRVAGMVCSLWVLLLVSSVLALEEVLLDTTGETSEIGWLTYPPGGWDEVS
VLDDQRRLTRTFEACHVAGAPPGTGQDNWLQTHFVERRGAQRAHIRLHFSVRACSSLGVS
GGTCRETFTLYYRQAEEPDSPDSVSSWHLKRWTKVDTIAADESFPSSSSSSSSSSSSAAW
AVGPHGAGQRAGLQLNVKERSFGPLTQRGFYVAFQDTGACLALVAVRLFSYTCPAVLRSF
ASFPETQASGAGGASLVAAVGTCVAHAEPEEDGVGGQAGGSPPRLHCNGEGKWMVAVGGC
RCQPGYQPARGDKACQACPRGLYKASAGNAPCSPCPARSHAPNPAAPVCPCLEGFYRASS
DPPEAPCTGPPSAPQELWFEVQGSALMLHWRLPRELGGRGDLLFNVVCKECEGRQEPASG
GGGTCHRCRDEVHFDPRQRGLTESRVLVGGLRAHVPYILEVQAVNGVSELSPDPPQAAAI
NVSTSHEVPSAVPVVHQVSRASNSITVSWPQPDQTNGNILDYQLRYYDQAEDESHSFTLT
SETNTATVTQLSPGHIYGFQVRARTAAGHGPYGGKVYFQTLPQGELSSQLPERLSLVIGS
TLGALAFLLLAAITVLAVVFQRKRRGTGYTEQLQQYSSPGLGVKYYIDPSTYEDPCQAIR
ELAREVDPAYIKIEEVIGTGSFGEVRQGRLQPRGRREQTVAIQALWAGGAESLQMTFLGR
AAVLGQFQHPNILRLEGVVTKSRPLMVLTEFMELGPLDSFLRQREGQFSSLQLVAMQRGV
AAAMQYLSSFAFVHRSLSAHSVLVNSHLVCKVARLGHSPQGPSCLLRWAAPEVIAHGKHT
HVGSDELWRTALLGHE signal sequence:
Amino acids 1-31

Transmembrane domains:
Amino acids 217-234;598-618

N-glycosylation site:
Amino acids 481-485

Glycosaminoglycan attachment sites:
Amino acids 249-253;419-423 cAMP- and cGMP-dependent protein kinase phosphorylation sites:
Amino acids 66-70;150-154;624-628

Tyrosine kinase phosphorylation sites:
Amino acids 644-673;664-671

N-myristoylation sites:
Amino acids 10-16;15-21;79-85;99-105;118-124;188-194;
192-198;218-224;250-256;261-267;275-281;276-282;298-304;321-
327;328-334;420-426;421-427;440-446;449-455;599-605;626-632;
708-714;766-772;779-785

Amidation site:
Amino acids 693-697

Cell attachment sequences:
Amino acids 310-313;399-402

FIGURE 35

```
GGGGTCTCCCTCAGGGCCGGGAGGCACAGCGGTCCCTGCTTGCTGAAGGGCTGGATGTAC
GCATCCGCAGGTTCCCGCGGACTTGGGGGCGCCCGCTGAGCCCCGGCGCCCGCAGAAGAC
TTGTGTTTGCCTCCTGCAGCCTCAACCCGGAGGGCAGCGAGGGCCTACCACCATGATCAC
TGGTGTGTTCAGCATGCGCTTGTGGACCCCAGTGGGCGTCCTGACCTCGCTGGCGTACTG
CCTGCACCAGCGGCGGGTGGCCCTGGCCGAGCTGCAGGAGGCCGATGGCCAGTGTCCGGT
CGACCGCAGCCTGCTGAAGTTGAAAATGGTGCAGGTCGTGTTTCGACACGGGGCTCGGAG
TCCTCTCAAGCCGCTCCCGCTGGAGGAGCAGGTAGAGTGGAACCCCAGCTATTAGAGGT
CCCACCCCAAACTCAGTTTGATTACACAGTCACCAATCTAGCTGGTGGTCCGAAACCATA
TTCTCCTTACGACTCTCAATACCATGAGACCACCCTGAAGGGGGGCATGTTTGCTGGGCA
GCTGACCAAGGTGGGCATGCAGCAAATGTTTGCCTTGGGAGAGAGACTGAGGAAGAACTA
TGTGGAAGACATTCCCTTTCTTTCACCAACCTTCAACCCACAGGAGGTCTTTATTCGTTC
CACTAACATTTTTCGGAATCTGGAGTCCACCCGTTGTTTGCTGGCTGGGCTTTTCCAGTG
TCAGAAAGAAGGACCCATCATCATCCACACTGATGAAGCAGATTCAGAAGTCTTGTATCC
CAACTACCAAAGCTGCTGGAGCCTGAGGCAGAGAACCAGAGGCCGGAGGCAGACTGCCTC
TTTACAGCCAGGAATCTCAGAGGATTTGAAAAGGTGAAGGACAGGATGGGCATTGACAG
TAGTGATAAAGTGGACTTCTTCATCCTCCTGGACAACGTGGCTGCCGAGCAGGCACACAA
CCTCCCAAGCTGCCCCATGCTGAAGAGATTTGCACGGATGATCGAACAGAGAGCTGTGGA
CACATCTTGTACATACTGCCCAAGGAAGACAGGGAAAGTCTTCAGATGGCAGTAGGCCC
ATTCCTCCACATCCTAGAGAGCAACCTGCTGAAAGCCATGGACTCTGCCACTGCCCCGA
CAAGATCAGAAAGCTGTATCTCTATGCGGCTCATGATGTGACCTTCATACCGCTCTTAAT
GACCCTGGGGATTTTTGACCACAAATGGCCACCGTTTGCTGTTGACCTGACCATGGAACT
TTACCAGCACCTGGAATCTAAGGAGTGGTTTGTGCAGCTCTATTACCACGGGAAGGAGCA
GGTGCCGAGAGGTTGCCCTGATGGGCTCTGCCCGCTGGACATGTTCTTGAATGCCATGTC
AGTTTATACCTTAAGCCCAGAAAAATACCATGCACTCTGCTCTCAAACTCAGGTGATGGA
AGTTGGAAATGAAGAGTAACTGATTTATAAAGCAGGATGTGTTGATTTTAAAATAAAGT
GCCTTTATACAATG
```

FIGURE 36

```
MITGVFSMRLWTPVGVLTSLAYCLHQRRVALAELQEADGQCPVDRSLLKLKMVQVVFRHG
ARSPLKPLPLEEQVEWNPQLLEVPPQTQFDYTVTNLAGGPKPYSPYDSQYHETTLKGGMF
AGQLTKVGMQQMFALGERLRKNYVEDIPFLSPTFNPQEVFIRSTNIFRNLESTRCLLAGL
FQCQKEGPIIIHTDEADSEVLYPNYQSCWSLRQRTRGRRQTASLQPGISEDLKKVKDRMG
IDSSDKVDFFILLDNVAAEQAHNLPSCPMLKRFARMIEQRAVDTSLYILPKEDRESLQMA
VGPFLHILESNLLKAMDSATAPDKIRKLYLYAAHDVTFIPLLMTLGIFDHKWPPFAVDLT
MELYQHLESKEWFVQLYYHGKEQVPRGCPDGLCPLDMFLNAMSVYTLSPEKYHALCSQTQ
VMEVGNEE
```

Signal sequence:
amino acids 1-23 cAMP- and cGMP-dependent protein kinase phosphorylation site:
amino acids 218-222

Casein kinase II phosphorylation site:
amino acids 87-91, 104-108, 320-324

Tyrosine kinase phosphorylation site:
amino acids 280-288

N-myristoylation site:
amino acids 15-21, 117-123, 118-124, 179-185, 240-246, 387-393

Amidation site:
amino acids 216-220

Leucine zipper pattern:
amino acids 10-32

Histidine acid phosphatases phosphohistidine signature:
amino acids 50-65

FIGURE 37

```
ACTGCACTCGGTTCTATCGATTGAATTCCCCGGGGATCCTCTAGAGATCCCTCGACCTCG
ACCCACGCGTCCGCGGACGCGTGGGCGGACGCGTGGGCCGGCTACCAGGAAGAGTCTGCC
GAAGGTGAAGGCCATGGACTTCATCACCTCCACAGCCATCCTGCCCCTGCTGTTCGGCTG
CCTGGGCGTCTTCGGCCTCTTCCGGCTGCTGCAGTGGGTGCGCGGGAAGGCCTACCTGCG
GAATGCTGTGGTGGTGATCACAGGCGCCACCTCAGGGCTGGGCAAAGAATGTGCAAAAGT
CTTCTATGCTGCGGGTGCTAAACTGGTGCTCTGTGGCCGGAATGGTGGGGCCCTAGAAGA
GCTCATCAGAGAACTTACCGCTTCTCATGCCACCAAGGTGCAGACACACAAGCCTTACTT
GGTGACCTTCGACCTCACAGACTCTGGGGCCATAGTTGCAGCAGCAGCTGAGATCCTGCA
GTGCTTTGGCTATGTCGACATACTTGTCAACAATGCTGGGATCAGCTACCGTGGTACCAT
CATGGACACCACAGTGGATGTGGACAAGAGGGTCATGGAGACAAACTACTTTGGCCCAGT
TGCTCTAACGAAAGCACTCCTGCCCTCCATGATCAAGAGGAGGCAAGGCCACATTGTCGC
CATCAGCAGCATCCAGGGCAAGATGAGCATTCCTTTTCGATCAGCATATGCAGCCTCCAA
GCACGCAACCCAGGCTTTCTTTGACTGTCTGCGTGCCGAGATGGAACAGTATGAAATTGA
GGTGACCGTCATCAGCCCCGGCTACATCCACACCAACCTCTCTGTAAATGCCATCACCGC
GGATGGATCTAGGTATGGAGTTATGGACACCACCACAGCCCAGGGCCGAAGCCCTGTGGA
GGTGGCCCAGGATGTTCTTGCTGCTGTGGGGAAGAAGAAGAAAGATGTGATCCTGGCTGA
CTTACTGCCTTCCTTGGCTGTTTATCTTCGAACTCTGGCTCCTGGGCTCTTCTTCAGCCT
CATGGCCTCCAGGGCCAGAAAAGAGCGGAAATCCAAGAACTCCTAGTACTCTGACCAGCC
AGGGCCAGGGCAGAGAAGCAGCACTCTTAGGCTTGCTTACTCTACAAGGGACAGTTGCAT
TTGTTGAGACTTTAATGGAGATTTGTCTCACAAGTGGGAAAGACTGAAGAAACACATCTC
GTGCAGATCTGCTGGCAGAGGACAATCAAAAACGACAACAAGCTTCTTCCCAGGGTGAGG
GGAAACACTTAAGGAATAAATATGGAGCTGGGTTTAACACTAAAAACTAGAAATAAACA
TCTCAAACAGTAAAAAAAAAAAAAAGGGCGGCCGCGACTCTAGAGTCGACCTGCAGAAG
CTTGGCCGCCATGGCCCAACTTGTTTATTGCAGCTTATAATGGTTAC
```

FIGURE 38

MDFITSTAILPLLFGCLGVFGLFRLLQWVRGKAYLRNAVVVITGATSGLGKECAKVFYAA
GAKLVLCGRNGGALEELIRELTASHATKVQTHKPYLVTFDLTDSGAIVAAAAEILQCFGY
VDILVNNAGISYRGTIMDTTVDVDKRVMETNYFGPVALTKALLPSMIKRRQGHIVAISSI
QGKMSIPFRSAYAASKHATQAFFDCLRAEMEQYEIEVTVISPGYIHTNLSVNAITADGSR
YGVMDTTTAQGRSPVEVAQDVLAAVGKKKKDVILADLLPSLAVYLRTLAPGLFFSLMASR
ARKERKSKNS

Signal sequence:
amino acids 1-21

Transmembrane domain:
amino acids 104-120, 278-292

N-glycosylation site:
amino acids 228-232

Glycosaminoglycan attachment site:
amino acids 47-51

Casein kinase II phosphorylation site:
amino acids 135-139, 139-143, 253-257

Tyrosine kinase phosphorylation site:
amino acids 145-153, 146-153

N-myristoylation site:
amino acids 44-50, 105-111, 238-244, 242-248, 291-297

Amidation site:
amino acids 265-269

Prokaryotic membrane lipoprotein lipid attachment site:
amino acids 6-17

FIGURE 39

```
GCAAGCCAAGGCGCTGTTTGAGAAGGTGAAGAAGTTCCGGACCCATGTGGAGGAGGGGGACATTGT
GTACCGCCTCTACATGCGGCAGACCATCATCAAGGTGATCAAGTTCATCCTCATCATCTGCTACAC
CGTCTACTACGTGCACAACATCAAGTTCGACGTGGACTGCACCGTGGACATTGAGAGCCTGACGGG
CTACCGCACCTACCGCTGTGCCCACCCCTGGCCACACTCTTCAAGATCCTGGCGTCCTTCTACAT
CAGCCTAGTCATCTTCTACGGCCTCATCTGCATGTACACACTGTGGTGGATGCTACGGCGCTCCCT
CAAGAAGTACTCGTTTGAGTCGATCCGTGAGGAGAGCAGCTACAGCGACATCCCCGACGTCAAGAA
CGACTTCGCCTTCATGCTGCACCTCATTGACCAATACGACCCGCTCTACTCCAAGCGCTTCGCCGT
CTTCCTGTCGGAGGTGAGTGAGAACAAGCTGCGGCAGCTGAACCTCAACAACGAGTGGACGCTGGA
CAAGCTCCGGCAGCGGCTCACCAAGAACGCGCAGGACAAGCTGGAGCTGCACCTGTTCATGCTCAG
TGGCATCCCTGACACTGTGTTTGACCTGGTGGAGCTGGAGGTCCTCAAGCTGGAGCTGATCCCCGA
CGTGACCATCCCGCCCAGCATTGCCCAGCTCACGGGCCTCAAGGAGCTGTGGCTCTACCACACAGC
GGCCAAGATTGAAGCGCCTGCGCTGGCCTTCCTGCGCGAGAACCTGCGGGCGCTGCACATCAAGTT
CACCGACATCAAGGAGATCCCGCTGTGGATCTATAGCCTGAAGACACTGGAGGAGCTGCACCTGAC
GGGCAACCTGAGCGCGGAGAACAACCGCTACATCGTCATCGACGGGCTGCGGGAGCTCAAACGCCT
CAAGGTGCTGCGGCTCAAGAGCAACCTAAGCAAGCTGCCACAGGTGGTCACAGATGTGGGCGTGCA
CCTGCAGAAGCTGTCCATCAACAATGAGGGCACCAAGCTCATCGTCCTCAACAGCCTCAAGAAGAT
GGCGAACCTGACTGAGCTGGAGCTGATCCGCTGCGACCTGGAGCGCATCCCCCACTCCATCTTCAG
CCTCCACAACCTGCAGGAGATTGACCTCAAGGACAACAACCTCAAGACCATCGAGGAGATCATCAG
CTTCCAGCACCTGCACCGCCTCACCTGCCTTAAGCTGTGGTACAACCACATCGCCTACATCCCCAT
CCAGATCGGCAACCTCACCAACCTGGAGCGCCTCTACCTGAACCGCAACAAGATCGAGAAGATCCC
CACCCAGCTCTTCTACTGCCGCAAGCTGCGCTACCTGGACCTCAGCCACAACAACCTGACCTTCCT
CCCTGCCGACATCGGCCTCCTGCAGAACCTCCAGAACCTAGCCATCACGGCCAACCGGATCGAGAC
GCTCCCTCCGGAGCTCTTCCAGTGCCGGAAGCTGCGGGCCCTGCACCTGGGCAACAACGTGCTGCA
GTCACTGCCCTCCAGGGTGGGCGAGCTGACCAACCTGACGCAGATCGAGCTGCGGGGCAACCGGCT
GGAGTGCCTGCCTGTGGAGCTGGGCGAGTGCCCACTGCTCAAGCGCAGCGGCTTGGTGGTGGAGGA
GGACCTGTTCAACACACTGCCACCCGAGGTGAAGGAGCGGCTGTGGAGGGCTGACAAGGAGCAGGC
CTGAGCGAGGCCGGCCCAGCACAGCAAGCAGCAGGACCGCTGCCCAGTCCTCAGGCCCGGAGGGGC
AGGCCTAGCTTCTCCCAGAACTCCCGGACAGCCAGGACAGCCTCGCGGCTGGGCAGGAGCCTGGGG
CCGCTTGTGAGTCAGGCCAGAGCGAGAGGACAGTATCTGTGGGGCTGGCCCCTTTTCTCCCTCTGA
GACTCACGTCCCCCAGGGCAAGTGCTTGTGGAGGAGAGCAAGTCTCAAGAGCGCAGTATTTGGATA
ATCAGGGTCTCCTCCCTGGAGGCCAGCTCTGCCCCAGGGGCTGAGCTGCCACCAGAGGTCCTGGGA
CCCTCACTTTAGTTCTTGGTATTTATTTTTCTCCATCTCCCACCTCCTTCATCCAGATAACTTATA
CATTCCCAAGAAAGTTCAGCCCAGATGGAAGGTGTTCAGGGAAAGGTGGGCTGCCTTTTCCCCTTG
TCCTTATTTAGCGATGCCGCCGGGCATTTAACACCCACCTGGACTTCAGCAGAGTGGTCCGGGGCG
AACCAGCCATGGGACGGTCACCCAGCAGTGCCGGGCTGGCTCTGCGGTGCGGTCCACGGGAGAGC
AGGCCTCCAGCTGGAAAGGCCAGGCCTGGAGCTTGCCTCTTCAGTTTTTGTGGCAGTTTTAGTTTT
TTGTTTTTTTTTTTTTTAATCAAAAAACAATTTTTTTTAAAAAAAAGCTTTGAAAATGGATGGTTT
GGGTATTAAAAAGAAAAAAAAAACTTAAAAAAAAAAAGACACTAACGGCCAGTGAGTTGGAGTCTC
AGGGCAGGGTGGCAGTTTCCCTTGAGCAAAGCAGCCAGACGTTGAACTGTGTTTCCTTTCCCTGGG
CGCAGGGTGCAGGGTGTCTTCCGGATCTGGTGTGACCTTGGTCCAGGAGTTCTATTTGTTCCTGGG
GAGGGAGGTTTTTTTGTTTGTTTTTTGGGTTTTTTTGGTGTCTTGTTTTCTTTCTCCTCCATGTGT
CTTGGCAGGCACTCATTTCTGTGGCTGTCGGCCAGAGGGAATGTTCTGGAGCTGCCAAGGAGGGAG
GAGACTCGGGTTGGCTAATCCCCGGATGAACGGTGCTCCATTCGCACCTCCCCTCCTCGTGCCTGC
CCTGCCTCTCCACGCACAGTGTTAAGGAGCCAAGAGGAGCCACTTCGCCCAGACTTTGTTTCCCCA
CCTCCTGCGGCATGGGTGTGTCCAGTGCCACCGCTGGCCTCCGCTGCTTCCATCAGCCCTGTCGCC
ACCTGGTCCTTCATGAAGAGCAGACACTTAGAGGCTGGTCGGGAATGGGGAGGTCGCCCCTGGGAG
GGCAGGCGTTGGTTCCAAGCCGGTTCCCGTCCCTGGCGCCTGGAGTGCACACAGCCCAGTCGGCAC
CTGGTGGCTGGAAGCCAACCTGCTTTAGATCACTCGGGTCCCACCTTAGAAGGGTCCCCGCCTTA
GATCAATCACGTGGACACTAAGGCACGTTTTAGAGTCTCTTGTCTTAATGATTATGTCCATCCGTC
TGTCCGTCCATTTGTGTTTTCTGCGTCGTGTCATTGGATATAATCCTCAGAAATAATGCACACTAG
CCTCTGACAACCATGAAGCAAAAATCCGTTACATGTGGGTCTGAACTTGTAGACTCGGTCACAGTA
TCAAATAAAATCTATAACAGAAAAAAAAAAAAAA
```

FIGURE 40

```
MRQTIIKVIKFILIICYTVYYVHNIKFDVDCTVDIESLTGYRTYRCAHPLATLFKILASF
YISLVIFYGLICMYTLWWMLRRSLKKYSFESIREESSYSDIPDVKNDFAFMLHLIDQYDP
LYSKRFAVFLSEVSENKLRQLNLNNEWTLDKLRQRLTKNAQDKLELHLFMLSGIPDTVFD
LVELEVLKLELIPDVTIPPSIAQLTGLKELWLYHTAAKIEAPALAFLRENLRALHIKFTD
IKEIPLWIYSLKTLEELHLTGNLSAENNRYIVIDGLRELKRLKVLRLKSNLSKLPQVVTD
VGVHLQKLSINNEGTKLIVLNSLKKMANLTELELIRCDLERIPHSIFSLHNLQEIDLKDN
NLKTIEEIISFQHLHRLTCLKLWYNHIAYIPIQIGNLTNLERLYLNRNKIEKIPTQLFYC
RKLRYLDLSHNNLTFLPADIGLLQNLQNLAITANRIETLPPELFQCRKLRALHLGNNVLQ
SLPSRVGELTNLTQIELRGNRLECLPVELGECPLLKRSGLVVEEDLFNTLPPEVKERLWR
ADKEQA
```

Transmembrane domain:
amino acids 51-75 (type II)

N-glycosylation site:
amino acids 262-266, 290-294, 328-332, 396-400, 432-436, 491-495 cAMP- and cGMP-dependent protein kinase phosphorylation site:
amino acids 85-89

Casein kinase II phosphorylation site:
amino acids 91-95, 97-101, 177-181, 253-257, 330-334, 364-368, 398-402, 493-497

N-myristoylation site:
amino acids 173-179, 261-267, 395-401, 441-447

FIGURE 41

```
GGGGGAGAAGGCGGCCGAGCCCCAGCTCTCCGAGCACCGGGTCGGAAGCCGCGACCCGAG
CCGCGCAGGAAGCTGGGACCGGAACCTCGGCGGACCCGGCCCCACCCAACTCACCTGCGC
AGGTCACCAGCACCCTCGGAACCCAGAGGCCCGCGCTCTGAAGGTGACCCCCTGGGGAG
GAAGGCGATGGCCCCTGCGAGGACGATGGCCCGCGCCCGCCTCGCCCCGGCCGGCATCCC
TGCCGTCGCCTTGTGGCTTCTGTGCACGCTCGGCCTCCAGGGCACCCAGGCCGGGCCACC
GCCCGCGCCCCTGGGCTGCCCGCGGGAGCCGACTGCCTGAACAGCTTTACCGCCGGGGT
GCCTGGCTTCGTGCTGGACACCAACGCCTCGGTCAGCAACGGAGCTACCTTCCTGGAGTC
CCCCACCGTGCGCCGGGGCTGGGACTGCGTGCGCGCCTGCTGCACCACCCAGAACTGCAA
CTTGGCGCTAGTGGAGCTGCAGCCCGACCGCGGGGAGGACGCCATCGCCGCCTGCTTCCT
CATCAACTGCCTCTACGAGCAGAACTTCGTGTGCAAGTTCGCGCCCAGGGAGGGCTTCAT
CAACTACCTCACGAGGGAAGTGTACCGCTCCTACCGCCAGCTGCGGACCCAGGGCTTTGG
AGGGTCTGGGATCCCCAAGGCCTGGGCAGGCATAGACTTGAAGGTACAACCCCAGGAACC
CCTGGTGCTGAAGGATGTGGAAAACACAGATTGGCGCCTACTGCGGGGTGACACGGATGT
CAGGGTAGAGAGGAAAGACCCAAACCAGGTGGAACTGTGGGGACTCAAGGAAGGCACCTA
CCTGTTCCAGCTGACAGTGACTAGCTCAGACCACCCAGAGGACACGGCCAACGTACAGT
CACTGTGCTGTCCACCAAGCAGACAGAAGACTACTGCCTCGCATCCAACAAGGTGGGTCG
CTGCCGGGGCTCTTTCCCACGCTGGTACTATGACCCCACGGAGCAGATCTGCAAGAGTTT
CGTTTATGGAGGCTGCTTGGGCAACAAGAACAACTACCTTCGGGAAGAAGAGTGCATTCT
AGCCTGTCGGGGTGTGCAAGGTGGGCCTTTGAGAGGCAGCTCTGGGGCTCAGGCGACTTT
CCCCCAGGGCCCCTCCATGGAAAGGCGCCATCCAGTGTGCTCTGGCACCTGTCAGCCCAC
CCAGTTCCGCTGCAGCAATGGCTGCTGCATCGACAGTTTCCTGGAGTGTGACGACACCCC
CAACTGCCCCGACGCCTCCGACGAGGCTGCCTGTGAAAAATACACGAGTGGCTTTGACGA
GCTCCAGCGCATCCATTTCCCCAGTGACAAAGGGCACTGCGTGGACCTGCCAGACACAGG
ACTCTGCAAGGAGAGCATCCCGCGCTGGTACTACAACCCCTTCAGCGAACACTGCGCCCG
CTTTACCTATGGTGGTTGTTATGGCAACAAGAACAACTTTGAGGAAGAGCAGCAGTGCCT
CGAGTCTTGTCGCGGCATCTCCAAGAAGGATGTGTTTGGCCTGAGGCGGGAAATCCCCAT
TCCCAGCACAGGCTCTGTGGAGATGGCTGTCACAGTGTTCCTGGTCATCTGCATTGTGGT
GGTGGTAGCCATCTTGGGTTACTGCTTCTTCAAGAACCAGAGAAAGGACTTCCACGGACA
CCACCACCACCCACCACCCACCCCTGCCAGCTCCACTGTCTCCACTACCGAGGACACGGA
GCACCTGGTCTATAACCACACCACCCGGCCCCTCTGAGCCTGGGTCTCACCGGCTCTCAC
CTGGCCCTGCTTCCTGCTTGCCAAGGCAGAGGCCTGGGCTGGGAAAAACTTTGGAACCAG
ACTCTTGCCTGTTTCCCAGGCCCACTGTGCCTCAGAGACCAGGGCTCCAGCCCCTCTTGG
AGAAGTCTCAGCTAAGCTCACGTCCTGAGAAAGCTCAAAGGTTTGGAAGGAGCAGAAAAC
CCTTGGGCCAGAAGTACCAGACTAGATGGACCTGCCTGCATAGGAGTTTGGAGGAAGTTG
GAGTTTTGTTTCCTCTGTTCAAAGCTGCCTGTCCCTACCCCATGGTGCTAGGAAGAGGAG
TGGGGTGGTGTCAGACCCTGGAGGCCCCAACCCTGTCCTCCCGAGCTCCTCTTCCATGCT
GTGCGCCCAGGGCTGGGAGGAAGGACTTCCCTGTGTAGTTTGTGCTGTAAAGAGTTGCTT
TTTGTTTATTTAATGCTGTGGCATGGGTGAAGAGGAGGGGAAGAGGCCTGTTTGGCCTCT
CTGTCCTCTCTTCCTCTTCCCCCAAGATTGAGCTCTCTGCCCTTGATCAGCCCCACCCTG
GCCTAGACCAGCAGACAGAGCCAGGAGAGGCTCAGCTGCATTCCGCAGCCCCCACCCCCA
AGGTTCTCCAACATCACAGCCCAGCCCACCCACTGGGTAATAAAAGTGGTTTGTGGAAAA
AAAAAAAAAAAAAAAAAAAAA
```

FIGURE 42

```
MAPARTMARARLAPAGIPAVALWLLCTLGLQGTQAGPPPAPPGLPAGADCLNSFTAGVPG
FVLDTNASVSNGATFLESPTVRRGWDCVRACCTTQNCNLALVELQPDRGEDAIAACFLIN
CLYEQNFVCKFAPREGFINYLTREVYRSYRQLRTQGFGGSGIPKAWAGIDLKVQPQEPLV
LKDVENTDWRLLRGDTDVRVERKDPNQVELWGLKEGTYLFQLTVTSSDHPEDTANVTVTV
LSTKQTEDYCLASNKVGRCRGSFPRWYYDPTEQICKSFVYGGCLGNKNNYLREEECILAC
RGVQGGPLRGSSGAQATFPQGPSMERRHPVCSGTCQPTQFRCSNGCCIDSFLECDDTPNC
PDASDEAACEKYTSGFDELQRIHFPSDKGHCVDLPDTGLCKESIPRWYYNPFSEHCARFT
YGGCYGNKNNFEEEQQCLESCRGISKKDVFGLRREIPIPSTGSVEMAVTVFLVICIVVVV
AILGYCFFKNQRKDFHGHHHHPPPTPASSTVSTTEDTEHLVYNHTTRPL
``` signal sequence:
Amino acids 1-35 transmembrane domain:
Amino acids 466-483

N-glycosylation sites:
Amino acids 66-70;235-239;523-527

N-myristoylation sites:
A m i n o     a c i d s
29-35;43-49;161-167;212-218;281-287;282-288;285-291;
310-316;313-319;422-428;423-429;426-432

Cell attachment sequence:
Amino acids 193-199

Pancreatic trypsin inhibitor (Kunitz) family signatures:
Amino acids 278-298;419-438

FIGURE 43

CCCACGCGTCCGCACCTCGGCCCCGGGCTCCGAAGCGGCTCGGGGGCGCCCTTTCGGTCA
ACATCGTAGTCCACCCCCTCCCCATCCCCAGCCCCGGGGATTCAGGCTCGCCAGCGCCC
AGCCAGGGAGCCGGCCGGGAAGCGCGATGGGGGCCCCAGCCGCCTCGCTCCTGCTCCTGC
TCCTGCTGTTCGCCTGCTGCTGGGCGCCCGGCGGGCCAACCTCTCCCAGGACGACAGCC
AGCCCTGGACATCTGATGAAACAGTGGTGGCTGGTGGCACCGTGGTGCTCAAGTGCCAAG
TGAAAGATCACGAGGACTCATCCCTGCAATGGTCTAACCCTGCTCAGCAGACTCTCTACT
TTGGGGAGAAGAGAGCCCTTCGAGATAATCGAATTCAGCTGGTTACCTCTACGCCCACG
AGCTCAGCATCAGCATCAGCAATGTGGCCCTGGCAGACGAGGGCGAGTACACCTGCTCAA
TCTTCACTATGCCTGTGCGAACTGCCAAGTCCCTCGTCACTGTGCTAGGAATTCCACAGA
AGCCCATCATCACTGGTTATAAATCTTCATTACGGGAAAAAGACACAGCCACCCTAAACT
GTCAGTCTTCTGGGAGCAAGCCTGCAGCCCGGCTCACCTGGAGAAAGGGTGACCAAGAAC
TCCACGGAGAACCAACCCGCATACAGGAAGATCCCAATGGTAAAACCTTCACTGTCAGCA
GCTCGGTGACATTCCAGGTTACCCGGGAGGATGATGGGGCGAGCATCGTGTGCTCTGTGA
ACCATGAATCTCTAAAGGGAGCTGACAGATCCACCTCTCAACGCATTGAAGTTTTATACA
CACCAACTGCGATGATTAGGCCAGACCCTCCCCATCCTCGTGAGGGCCAGAAGCTGTTGC
TACACTGTGAGGGTCGCGGCAATCCAGTCCCCCAGCAGTACCTATGGGAGAAGGAGGGCA
GTGTGCCACCCCTGAAGATGACCCAGGAGAGTGCCCTGATCTTCCCTTTCCTCAACAAGA
GTGACAGTGGCACCTACGGCTGCACAGCCACCAGCAACATGGGCAGCTACAAGGCCTACT
ACACCCTCAATGTTAATGACCCCAGTCCGGTGCCCTCCTCCTCCAGCACCTACCACGCCA
TCATCGGTGGGATCGTGGCTTTCATTGTCTTCCTGCTGCTCATCATGCTCATCTTCCTTG
GCCACTACTTGATCCGGCACAAAGGAACCTACCTGACACATGAGGCAAAAGGCTCCGACG
ATGCTCCAGACGCGGACACGGCCATCATCAATGCAGAAGGCGGGCAGTCAGGAGGGACG
ACAAGAAGGAATATTTCATCTAGAGGCGCCTGCCCACTTCCTGCGCCCCCAGGGGCCCT
GTGGGGACTGCTGGGGCCGTCACCAACCCGGACTTGTACAGAGCAACCGCAGGGCCGCCC
CTCCCGCTTGCTCCCCAGCCCACCCACCCCCTGTACAGAATGTCTGCTTTGGGTGCGGT
TTTGTACTCGGTTTGGAATGGGGAGGGAGGAGGGCGGGGGGAGGGAGGGTTGCCCTCAG
CCCTTTCCGTGGCTTCTCTGCATTTGGGTTATTATTATTTTTGTAACAATCCCAAATCAA
ATCTGTCTCCAGGCTGGAGAGGCAGGAGCCCTGGGGTGAGAAAGCAAAAACAAACAAA
AAACA

FIGURE 44

MGAPAASLLLLLLLFACCWAPGGANLSQDDSQPWTSDETVVAGGTVVLKCQVKDHEDSSL
QWSNPAQQTLYFGEKRALRDNRIQLVTSTPHELSISISNVALADEGEYTCSIFTMPVRTA
KSLVTVLGIPQKPIITGYKSSLREKDTATLNCQSSGSKPAARLTWRKGDQELHGEPTRIQ
EDPNGKTFTVSSSVTFQVTREDDGASIVCSVNHESLKGADRSTSQRIEVLYTPTAMIRPD
PPHPREGQKLLLHCEGRGNPVPQQYLWEKEGSVPPLKMTQESALIFPFLNKSDSGTYGCT
ATSNMGSYKAYYTLNVNDPSPVPSSSSTYHAIIGGIVAFIVFLLLIMLIFLGHYLIRHKG
TYLTHEAKGSDDAPDADTAIINAEGGQSGGDDKKEYFI

Signal sequence:
amino acids 1-20

Transmembrane domain:
amino acids 331-352

N-glycosylation site:
amino acids 25-29, 290-294

Casein kinase II phosphorylation site:
amino acids 27-31, 35-39, 89-93, 141-145, 199-203, 388-392

N-myristoylation site:
amino acids 2-8, 23-29, 156-162, 218-224, 295-301, 298-304, 306-310, 334-340, 360-364, 385-389, 386-390

Prokaryotic membrane lipoprotein lipid attachment site:
amino acids 7-18

FIGURE 45

```
ACTTGCCATCACCTGTTGCCAGTGTGGAAAAATTCTCCCTGTTGAATTTTTTGCACATGG
AGGACAGCAGCAAAGAGGGCAACACAGGCTGATAAGACCAGAGACAGCAGGGAGATTATT
TTACCATACGCCCTCAGGACGTTCCCTCTAGCTGGAGTTCTGGACTTCAACAGAACCCCA
TCCAGTCATTTTGATTTTGCTGTTTATTTTTTTTTCTTTTTCTTTTTCCCACCACATTG
TATTTTATTTCCGTACTTCAGAAATGGGCCTACAGACCACAAAGTGGCCCAGCCATGGGG
CTTTTTTCCTGAAGTCTTGGCTTATCATTTCCCTGGGGCTCTACTCACAGGTGTCCAAAC
TCCTGGCCTGCCCTAGTGTGTGCCGCTGCGACAGGAACTTTGTCTACTGTAATGAGCGAA
GCTTGACCTCAGTGCCTCTTGGGATCCCGGAGGGCGTAACCGTACTCTACCTCCACAACA
ACCAAATTAATAATGCTGGATTTCCTGCAGAACTGCACAATGTACAGTCGGTGCACACGG
TCTACCTGTATGGCAACCAACTGGACGAATTCCCCATGAACCTTCCCAAGAATGTCAGAG
TTCTCCATTTGCAGGAAAACAATATTCAGACCATTTCACGGGCTGCTCTTGCCCAGCTCT
TGAAGCTTGAAGAGCTGCACCTGGATGACAACTCCATATCCACAGTGGGGTGGAAGACG
GGGCCTTCCGGGAGGCTATTAGCCTCAAATTGTTGTTTTGTCTAAGAATCACCTGAGCA
GTGTGCCTGTTGGGCTTCCTGTGGACTTGCAAGAGCTGAGAGTGGATGAAAATCGAATTG
CTGTCATATCCGACATGGCCTTCCAGAATCTACGAGCTTGGAGCGTCTTATTGTGGACG
GGAACCTCCTGACCAACAAGGGTATCGCCGAGGGCACCTTCAGCCATCTCACCAAGCTCA
AGGAATTTTCAATTGTACGTAATTCGCTGTCCCACCCTCCTCCCGATCTCCCAGGTACGC
ATCTGATCAGGCTCTATTTGCAGGACAACCAGATAAACCACATTCCTTTGACAGCCTTCT
CAAATCTGCGTAAGCTGGAACGGCTGGATATATCCAACAACCAACTGCGGATGCTGACTC
AAGGGGTTTTTGATAATCTCTCCAACCTGAAGCAGCTCACTGCTCGGAATAACCCTTGGT
TTTGTGACTGCAGTATTAAATGGGTCACAGAATGGCTCAAATATATCCCTTCATCTCTCA
ACGTGCGGGGTTTCATGTGCCAAGGTCCTGAACAAGTCCGGGGGATGGCCGTCAGGGAAT
TAAATATGAATCTTTTGTCCTGTCCCACCACGACCCCCGGCCTGCCTCTCTTCACCCCAG
CCCCAAGTACAGCTTCTCCGACCACTCAGCCTCCCACCCTCTCTATTCCAAACCCTAGCA
GAAGCTACACGCCTCCAACTCCTACCACATCGAAACTTCCCACGATTCCTGACTGGGATG
GCAGAGAAAGAGTGACCCCACCTATTTCTGAACGGATCCAGCTCTCTATCCATTTTGTGA
ATGATACTTCCATTCAAGTCAGCTGGCTCTCTCTCTTCACCGTGATGGCATACAAACTCA
CATGGGTGAAAATGGGCCACAGTTTAGTAGGGGGCATCGTTCAGGAGCGCATAGTCAGCG
GTGAGAAGCAACACCTGAGCCTGGTTAACTTAGAGCCCCGATCCACCTATCGGATTTGTT
TAGTGCCACTGGATGCTTTTAACTACCGCGCGGTAGAAGACACCATTTGTTCAGAGGCCA
CCACCCATGCCTCCTATCTGAACAACGGCAGCAACACAGCGTCCAGCCATGAGCAGACGA
CGTCCCACAGCATGGGCTCCCCCTTTCTGCTGGCGGGCTTGATCGGGGCGCGGTGATAT
TTGTGCTGGTGGTCTTGCTCAGCGTCTTTTGCTGGCATATGCACAAAAGGGGCGCTACA
CCTCCCAGAAGTGGAAATACAACCGGGGCCGGCGGAAAGATGATTATTGCGAGGCAGGCA
CCAAGAAGGACAACTCCATCCTGGAGATGACAGAAACCAGTTTTCAGATCGTCTCCTTAA
ATAACGATCAACTCCTTAAAGGAGATTTCAGACTGCAGCCCATTTACACCCCAAATGGGG
GCATTAATTACACAGACTGCCATATCCCCAACAACATGCGATACTGCAACAGCAGCGTGC
CAGACCTGGAGCACTGCCATACGTGACAGCCAGAGGCCCAGCGTTATCAAGGCGGACAAT
TAGACTCTTGAGAACACACTCGTGTGTGCACATAAAGACACGCAGATTACATTTGATAAA
TGTTACACAGATGCATTTGTGCATTTGAATACTCTGTAATTTATACGGTGTACTATATAA
TGGGATTTAAAAAAAGTGCTATCTTTTCTATTTCAAGTTAATTACAAACAGTTTTGTAAC
TCTTTGCTTTTTAAATCTT
```

FIGURE 46

```
MGLQTTKWPSHGAFFLKSWLIISLGLYSQVSKLLACPSVCRCDRNFVYCNERSLTSVPLG
IPEGVTVLYLHNNQINNAGFPAELHNVQSVHTVYLYGNQLDEFPMNLPKNVRVLHLQENN
IQTISRAALAQLLKLEELHLDDNSISTVGVEDGAFREAISLKLLFLSKNHLSSVPVGLPV
DLQELRVDENRIAVISDMAFQNLTSLERLIVDGNLLTNKGIAEGTFSHLTKLKEFSIVRN
SLSHPPPDLPGTHLIRLYLQDNQINHIPLTAFSNLRKLERLDISNNQLRMLTQGVFDNLS
NLKQLTARNNPWFCDCSIKWVTEWLKYIPSSLNVRGFMCQGPEQVRGMAVRELNMNLLSC
PTTTPGLPLFTPAPSTASPTTQPPTLSIPNPSRSYTPPTPTTSKLPTIPDWDGRERVTPP
ISERIQLSIHFVNDTSIQVSWLSLFTVMAYKLTWVKMGHSLVGGIVQERIVSGEKQHLSL
VNLEPRSTYRICLVPLDAFNYRAVEDTICSEATTHASYLNNGSNTASSHEQTTSHSMGSP
FLLAGLIGGAVIFVLVVLLSVFCWHMHKKGRYTSQKWKYNRGRRKDDYCEAGTKKDNSIL
EMTETSFQIVSLNNDQLLKGDFRLQPIYTPNGGINYTDCHIPNNMRYCNSSVPDLEHCHT
```

Signal peptide:
amino acids 1-42

Transmembrane domain:
amino acids 542-561

N-glycosylation site:
amino acids 202-206, 298-302, 433-437, 521-525, 635-639, 649-653

Casein kinase II phosphorylation site:
amino acids 204-208, 407-411, 527-531, 593-597, 598-602, 651-655

Tyrosine kinase phosphorylation site:
amino acids 319-328

N-myristoylation site:
amino acids 2-8, 60-66, 149-155, 213-219, 220-226, 294-300, 522-528, 545-551, 633-639

Amidation site:
amino acids 581-585

Leucine zipper pattern:
amino acids 164-186

Phospholipase A2 aspartic acid active site:
amino acids 39-50

FIGURE 47

```
GCAGCGAGCGCCGGGTGCGGCCCTGCCGCCGCAGGGATGTGACCTTCACCGTCGCTTAGC
CAGGATGACCGGAGCCCGTGTCTCGCGGCGTCCGCGCCTCGCTTCAGCCTCCCGGGTGCT
CTGACCGCACGCTCCCGGCTGCTAGGCTCCCCGGCACCGGCCTCGCCATGCCGCCACCGC
CCGGGCCCGCCGCCGCCCTGGGCACTGCGCTTCTGCTGCTCCTGCTGGCTTCCGAGTCTT
CTCACACTGTGCTGTTGCGGGCGCGTGAGGCGGCGCAGTTTCTGCGGCCCAGGCAGCGCC
GCGCCTACCAAGTCTTCGAGGAGGCCAAGCAGGGCCACCTGGAACGGGAGTGCGTGGAGG
AGGTGTGCAGCAAAGAGGAGGCCAGAGAGGTGTTCGAGAACGACCCCGAGACGGAGTATT
TCTATCCACGATATCAAGAGTGCATGAGAAATATGGCAGGCCTGAAGAAAAAAACCCAG
ATTTCGCCAAATGTGTTCAGAACTTGCCTGACCAGTGCACCCCAAACCCTTGTGATAAGA
AGGGTACTCATATCTGCCAAGACCTCATGGGCAACTTCTTCTGCGTGTGCACAGATGGCT
GGGGAGGCCGGCTCTGTGACAAAGATGTCAATGAGTGTGTCCAGAAGAATGGGGGCTGCA
GCCAGGTCTGCCACAACAAACCAGGAAGCTTCCAATGTGCCTGCCATAGTGGCTTCTCGC
TTGCATCAGACGGCCAGACCTGCCAAGATATCGATGAATGCACAGACTCAGACACCTGTG
GGGACGCGCGATGCAAGAACTTGCCAGGCTCCTACTCTTGCCTCTGCGATGAGGGATATA
CATACAGCTCCAAGGAGAAGACCTGCCAAGATGTGGACGAGTGCCAGCAGGATCGCTGTG
AGCAGACCTGTGTCAACTCCCCAGGCAGCTATACCTGCCACTGTGATGGGCGAGGGGGCC
TAAAACTATCCCCAGACATGGATACTTGTGAGGACATCTTACCATGTGTGCCCTTCAGCA
TGGCCAAGAGCGTGAAGTCCTTGTACCTGGGCCGCATGTTCAGCGGGACCCCCGTGATTA
GACTACGCTTCAAGAGGCTTCAGCCTACCAGGCTGCTGGCTGAATTTGACTTCCGCACTT
TTGACCCTGAAGGAGTCCTCTTCTTCGCTGGAGGCCGTTCAGACAGCACCTGGATTGTCC
TGGGCCTAAGAGCTGGGCGGCTTGAGCTGCAGCTTCGGTACAATGGCGTTGGGCGCATCA
CCAGCAGCGGGCCAACCATCAACCACGGCATGTGGCAAACTATCTCCGTGGAAGAGCTGG
AACGTAACCTTGTCATCAAGGTCAACAAAGATGCTGTAATGAAGATCGCGGTAGCTGGGG
AGCTGTTTCAGCTGGAGAGGGGCCTCTATCACCTGAATCTCACCGTGGGCGGCATTCCCT
TCAAGGAGAGTGAGCTCGTCCAGCCGATTAACCCTCGCCTGGATGGGTGCATGAGGAGTT
GGAACTGGCTGAACGGGGAAGACAGCGCCATCCAGGAGACAGTCAAGGCAAACACAAAAA
TGCAGTGCTTCTCTGTGACAGAAAGGGGCTCCTTCTTCCCGGGGAATGGATTTGCTACCT
ACAGGCTCAACTACACCCGAACATCGCTGGATGTCGGCACGGAAACCACCTGGGAAGTTA
AGTTGTGGCTCGGATCCGCCCTGCCACGGACACGGGGGTGCTGCTGGCGCTGGTGGGGG
ACGACGATGTCGTCATCTCTGTGGCCCTAGTCGACTACCACTCTACAAAGAAGCTCAAGA
AGCAGTTGGTGGTCCTGGCAGTTGAGGATGTTGCCCTGGCACTGATGGAAATCAAGGTGT
GCGACAGCCAGGAACACACGGTCACTGTCTCCCTGCGGGAGGGTGAGGCCACCCTAGAAG
TGGATGGCACAAAGGGCCAGAGTGAAGTGAGCACTGCCCAGCTGCAGGAGCGACTGGACA
CACTTAAGACACATCTGCAAGGCTCTGTGCACACCTATGTTGGAGGCCTGCCAGAAGTAT
CGGTGATTTCTGCACCCGTCACTGCGTTCTACCGCGGATGCATGACTCTGGAGGTAAACG
GGAAAATCCTGGACCTGGATACGGCCTCGTACAAGCACAGTGACATCACCTCCCACTCCT
GCCCGCCTGTGGAGCATGCCACCCCCTAGACCGAGCTGCAAGAGGGCTCCACACCTAAAG
ACAAAAATGAAGCAGGGTTTGGACACACAGCACTGGCTCCTCTCGCATGGTCCTGCAACA
CTGGAGCAGCGTGGACCGCCCTTGTGGTTTTTTTTCTTGAGATCTTTCTTTTTGCCTTG
TAACATATCTGTACATAATGGACGGGTGTCGGGTCACCGGCTGCTCAGAGAGAGCCACGT
GACCTGGTGGGAGCTGGCTGGAAGGGGCTGGGCTAGAGGGGCTGGCAGTTTGCAGCAGAA
CGGATGTGAAGAAAATAATTCTCTATTATTTTATTACTACATGCTTCTTTCTGACTCTA
AAATATGGAAAATAAAATATTTACAGAACCTTTTAAAAAAAAAAAAAAAAAA
```

FIGURE 48

MPPPPGPAAALGTALLLLLLLASESSHTVLLRAREAAQFLRPRQRRAYQVFEEAKQGHLER
ECVEEVCSKEEAREVFENDPETEYFYPRYQECMRKYGRPEEKNPDFAKCVQNLPDQCTPN
PCDKKGTHICQDLMGNFFCVCTDGWGGRLCDKDVNECVQKNGGCSQVCHNKPGSFQCACH
SGFSLASDGQTCQDIDECTDSDTCGDARCKNLPGSYSCLCDEGYTYSSKEKTCQDVDECQ
QDRCEQTCVNSPGSYTCHCDGRGGLKLSPDMDTCEDILPCVPFSMAKSVKSLYLGRMFSG
TPVIRLRFKRLQPTRLLAEFDFRTFDPEGVLFFAGGRSDSTWIVLGLRAGRLELQLRYNG
VGRITSSGPTINHGMWQTISVEELERNLVIKVNKDAVMKIAVAGELFQLERGLYHLNLTV
GGIPFKESELVQPINPRLDGCMRSWNWLNGEDSAIQETVKANTKMQCFSVTERGSFFPGN
GFATYRLNYTRTSLDVGTETTWEVKVVARIRPATDTGVLLALVGDDDVVISVALVDYHST
KKLKKQLVVLAVEDVALALMEIKVCDSQEHTVTVSLREGEATLEVDGTKGQSEVSTAQLQ
ERLDTLKTHLQGSVHTYVGGLPEVSVISAPVTAFYRGCMTLEVNGKILDLDTASYKHSDI
TSHSCPPVEHATP

FIGURE 49

```
CGCCGCGCTCCCGCACCCGCGGCCCGCCCACCGCGCCGCTCCCGCATCTGCACCCGCAGC
CCGGCGGCCTCCCGGCGGGAGCGAGCAGATCCAGTCCGGCCCGCAGCGCAACTCGGTCCA
GTCGGGGCGGCGGCTGCGGGCGCAGAGCGGAGATGCAGCGGCTTGGGGCCACCCTGCTGT
GCCTGCTGCTGGCGGCGGCGGTCCCCACGGCCCCGCGCCCGCTCCGACGGCGACCTCGG
CTCCAGTCAAGCCCGGCCCGGCTCTCAGCTACCGCAGGAGGAGGCCACCCTCAATGAGA
TGTTCCGCGAGGTTGAGGAACTGATGGAGGACACGCAGCACAAATTGCGCAGCGCGGTGG
AAGAGATGGAGGCAGAAGAAGCTGCTGCTAAAGCATCATCAGAAGTGAACCTGGCAAACT
TACCTCCCAGCTATCACAATGAGACCAACACAGACACGAAGGTTGGAAATAATACCATCC
ATGTGCACCGAGAAATTCACAAGATAACCAACAACCAGACTGGACAAATGGTCTTTTCAG
AGACAGTTATCACATCTGTGGGAGACGAAGAAGGCAGAAGGAGCCACGAGTGCATCATCG
ACGAGGACTGTGGGCCCAGCATGTACTGCCAGTTTGCCAGCTTCCAGTACACCTGCCAGC
CATGCCGGGGCCAGAGGATGCTCTGCACCCGGGACAGTGAGTGCTGTGGAGACCAGCTGT
GTGTCTGGGGTCACTGCACCAAAATGGCCACCAGGGGCAGCAATGGGACCATCTGTGACA
ACCAGAGGGACTGCCAGCCGGGGCTGTGCTGTGCCTTCCAGAGAGGCCTGCTGTTCCCTG
TGTGCACACCCTGCCCGTGGAGGGCGAGCTTTGCCATGACCCCGCCAGCCGGCTTCTGG
ACCTCATCACCTGGGAGCTAGAGCCTGATGGAGCCTTGGACCGATGCCCTTGTGCCAGTG
GCCTCCTCTGCCAGCCCCACAGCCACAGCCTGGTGTATGTGTGCAAGCCGACCTTCGTGG
GGAGCCGTGACCAAGATGGGGAGATCCTGCTGCCCAGAGAGGTCCCCGATGAGTATGAAG
TTGGCAGCTTCATGGAGGAGGTGCGCCAGGAGCTGGAGGACCTGGAGAGGAGCCTGACTG
AAGAGATGGCGCTGGGGGAGCCTGCGGCTGCCGCCGCTGCACTGCTGGGAGGGGAAGAGA
TTTAGATCTGGACCAGGCTGTGGGTAGATGTGCAATAGAAATAGCTAATTTATTTCCCCA
GGTGTGTGCTTTAGGCGTGGGCTGACCAGGCTTCTTCCTACATCTTCTTCCCAGTAAGTT
TCCCCTCTGGCTTGACAGCATGAGGTGTTGTGCATTTGTTCAGCTCCCCCAGGCTGTTCT
CCAGGCTTCACAGTCTGGTGCTTGGGAGAGTCAGGCAGGGTTAAACTGCAGGAGCAGTTT
GCCACCCCTGTCCAGATTATTGGCTGCTTTGCCTCTACCAGTTGGCAGACAGCCGTTTGT
TCTACATGGCTTTGATAATTGTTTGAGGGGAGGAGATGGAAACAATGTGGAGTCTCCCTC
TGATTGGTTTTGGGGAAATGTGGAGAAGAGTGCCCTGCTTTGCAAACATCAACCTGGCAA
AAATGCAACAAATGAATTTTCCACGCAGTTCTTTCCATGGGCATAGGTAAGCTGTGCCTT
CAGCTGTTGCAGATGAAATGTTCTGTTCACCCTGCATTACATGTGTTTATTCATCCAGCA
GTGTTGCTCAGCTCCTACCTCTGTGCCAGGGCAGCATTTTCATATCCAAGATCAATTCCC
TCTCTCAGCACAGCCTGGGGAGGGGGTCATTGTTCTCCTCGTCCATCAGGGATCTCAGAG
GCTCAGAGACTGCAAGCTGCTTGCCCAAGTCACACAGCTAGTGAAGACCAGAGCAGTTTC
ATCTGGTTGTGACTCTAAGCTCAGTGCTCTCTCCACTACCCCACACCAGCCTTGGTGCCA
CCAAAAGTGCTCCCCAAAAGGAAGGAGAATGGGATTTTTCTTGAGGCATGCACATCTGGA
ATTAAGGTCAAACTAATTCTCACATCCCTCTAAAAGTAAACTACTGTTAGGAACAGCAGT
GTTCTCACAGTGTGGGGCAGCCGTCCTTCTAATGAAGACAATGATATTGACACTGTCCCT
CTTTGGCAGTTGCATTAGTAACTTTGAAAGGTATATGACTGAGCGTAGCATACAGGTTAA
CCTGCAGAAACAGTACTTAGGTAATTGTAGGGCGAGGATTATAAATGAAATTTGCAAAAT
CACTTAGCAGCAACTGAAGACAATTATCAACCACGTGGAGAAAATCAAACCGAGCAGGGC
TGTGTGAAACATGGTTGTAATATGCGACTGCGAACACTGAACTCTACGCCACTCCACAAA
TGATGTTTTCAGGTGTCATGGACTGTTGCCACCATGTATTCATCCAGAGTTCTTAAAGTT
TAAAGTTGCACATGATTGTATAAGCATGCTTTCTTTGAGTTTTAAATTATGTATAAACAT
AAGTTGCATTTAGAAATCAAGCATAAATCACTTCAACTGCAAAAAAAAAAAAAAAAAAA
AAAAAA
```

FIGURE 50

MQRLGATLLCLLLAAAVPTAPAPAPTATSAPVKPGPALSYPQEEATLNEMFREVEELMED
TQHKLRSAVEEMEAEEAAAKASSEVNLANLPPSYHNETNTDTKVGNNTIHVHREIHKITN
NQTGQMVFSETVITSVGDEEGRRSHECIIDEDCGPSMYCQFASFQYTCQPCRGQRMLCTR
DSECCGDQLCVWGHCTKMATRGSNGTICDNQRDCQPGLCCAFQRGLLFPVCTPLPVEGEL
CHDPASRLLDLITWELEPDGALDRCPCASGLLCQPHSHSLVYVCKPTFVGSRDQDGEILL
PREVPDEYEVGSFMEEVRQELEDLERSLTEEMALGEPAAAAAALLGGEEI

Signal sequence:
amino acids 1-19

N-glycosylation site:
amino acids 96-100, 106-110, 121-125, 204-208

Casein kinase II phosphorylation site:
amino acids 46-50, 67-71, 98-102, 135-139, 206-210, 312-316, 327-331

N-myristoylation site:
amino acids 202-208, 217-223

Amidation site:
amino acids 140-144

FIGURE 51

```
GCCTGTTGCTGATGCTGCCGTGCGGTACTTGTCATGGAGCTGGCACTGCGGCGCTCTCCC
GTCCCGCGGTGGTTGCTGCTGCTGCCGCTGCTGCTGGGCCTGAACGCAGGAGCTGTCATT
GACTGGCCCACAGAGGAGGGCAAGGAAGTATGGGATTATGTGACGGTCCGCAAGGATGCC
TACATGTTCTGGTGGCTCTATTATGCCACCAACTCCTGCAAGAACTTCTCAGAACTGCCC
CTGGTCATGTGGCTTCAGGGCGGTCCAGGCGGTTCTAGCACTGGATTTGGAAACTTTGAG
GAAATTGGGCCCCTTGACAGTGATCTCAAACCACGGAAAACCACCTGGCTCCAGGCTGCC
AGTCTCCTATTTGTGGATAATCCCGTGGGCACTGGGTTCAGTTATGTGAATGGTAGTGGT
GCCTATGCCAAGGACCTGGCTATGGTGGCTTCAGACATGATGGTTCTCCTGAAGACCTTC
TTCAGTTGCCACAAAGAATTCCAGACAGTTCCATTCTACATTTTCTCAGAGTCCTATGGA
GGAAAAATGGCAGCTGGCATTGGTCTAGAGCTTTATAAGGCCATTCAGCGAGGGACCATC
AAGTGCAACTTTGCGGGGGTTGCCTTGGGTGATTCCTGGATCTCCCCTGTTGATTCGGTG
CTCTCCTGGGGACCTTACCTGTACAGCATGTCTCTTCTCGAAGACAAAGGTCTGGCAGAG
GTGTCTAAGGTTGCAGAGCAAGTACTGAATGCCGTAAATAAGGGGCTCTACAGAGAGGCC
ACAGAGCTGTGGGGGAAAGCAGAAATGATCATTGAACAGAACACAGATGGGGTGAACTTC
TATAACATCTTAACTAAAAGCACTCCCACGTCTACAATGGAGTCGAGTCTAGAATTCACA
CAGAGCCACCTAGTTTGTCTTTGTCAGCGCCACGTGAGACACCTACAACGAGATGCCTTA
AGCCAGCTCATGAATGGCCCCATCAGAAAGAAGCTCAAAATTATTCCTGAGGATCAATCC
TGGGGAGGCCAGGCTACCAACGTCTTTGTGAACATGGAGGAGGACTTCATGAAGCCAGTC
ATTAGCATTGTGGACGAGTTGCTGGAGGCAGGGATCAACGTGACGGTGTATAATGGACAG
CTGGATCTCATCGTAGATACCATGGGTCAGGAGGCCTGGGTGCGGAAACTGAAGTGGCCA
GAACTGCCTAAATTCAGTCAGCTGAAGTGGAAGGCCCTGTACAGTGACCCTAAATCTTTG
GAAACATCTGCTTTTGTCAAGTCCTACAAGAACCTTGCTTTCTACTGGATTCTGAAAGCT
GGTCATATGGTTCCTTCTGACCAAGGGGACATGGCTCTGAAGATGATGAGACTGGTGACT
CAGCAAGAATAGGATGGATGGGGCTGGAGATGAGCTGGTTTGGCCTTGGGGCACAGAGCT
GAGCTGAGGCCGCTGAAGCTGTAGGAAGCGCCATTCTTCCCTGTATCTAACTGGGGCTGT
GATCAAGAAGGTTCTGACCAGCTTCTGCAGAGGATAAAATCATTGTCTCTGGAGGCAATT
TGGAAATTATTTCTGCTTCTTAAAAAAACCTAAGATTTTTTAAAAAATTGATTTGTTTTG
ATCAAAATAAAGGATGATAATAGATATTAA
```

FIGURE 52

```
MELALRRSPVPRWLLLLPLLLGLNAGAVIDWPTEEGKEVWDYVTVRKDAYMFWWLYYATN
SCKNFSELPLVMWLQGGPGGSSTGFGNFEEIGPLDSDLKPRKTTWLQAASLLFVDNPVGT
GFSYVNGSGAYAKDLAMVASDMMVLLKTFFSCHKEFQTVPFYIFSESYGGKMAAGIGLEL
YKAIQRGTIKCNFAGVALGDSWISPVDSVLSWGPYLYSMSLLEDKGLAEVSKVAEQVLNA
VNKGLYREATELWGKAEMIIEQNTDGVNFYNILTKSTPTSTMESSLEFTQSHLVCLCQRH
VRHLQRDALSQLMNGPIRKKLKIIPEDQSWGGQATNVFVNMEEDFMKPVISIVDELLEAG
INVTVYNGQLDLIVDTMGQEAWVRKLKWPELPKFSQLKWKALYSDPKSLETSAFVKSYKN
LAFYWILKAGHMVPSDQGDMALKMMRLVTQQE
```

Signal sequence:
amino acids 1-25

N-glycosylation site:
amino acids 64-68, 126-130, 362-366 cAMP- and cGMP-dependent protein kinase phosphorylation site:
amino acids 101-105

Casein kinase II phosphorylation site:
amino acids 204-208, 220-224, 280-284, 284-288, 351-355, 449-453

N-myristoylation site:
amino acids 22-28, 76-82, 79-85, 80-86, 119-125, 169-175, 187-193, 195-201, 331-337, 332-338, 360-366

FIGURE 53

```
GTCTGTTCCCAGGAGTCCTTCGGCGGCTGTTGTGTCAGTGGCCTGATCGCGATGGGGACA
AAGGCGCAAGTCGAGAGGAAACTGTTGTGCCTCTTCATATTGGCGATCCTGTTGTGCTCC
CTGGCATTGGGCAGTGTTACAGTGCACTCTTCTGAACCTGAAGTCAGAATTCCTGAGAAT
AATCCTGTGAAGTTGTCCTGTGCCTACTCGGGCTTTTCTTCTCCCGTGTGGAGTGGAAG
TTTGACCAAGGAGACACCACCAGACTCGTTTGCTATAATAACAAGATCACAGCTTCCTAT
GAGGACCGGGTGACCTTCTTGCCAACTGGTATCACCTTCAAGTCCGTGACACGGGAAGAC
ACTGGGACATACACTTGTATGGTCTCTGAGGAAGGCGGCAACAGCTATGGGGAGGTCAAG
GTCAAGCTCATCGTGCTTGTGCCTCCATCCAAGCCTACAGTTAACATCCCTCCTCTGCC
ACCATTGGGAACCGGGCAGTGCTGACATGCTCAGAACAAGATGGTTCCCCACCTTCTGAA
TACACCTGGTTCAAAGATGGGATAGTGATGCCTACGAATCCCAAAAGCACCCGTGCCTTC
AGCAACTCTTCCTATGTCCTGAATCCCACAACAGGAGAGCTGGTCTTTGATCCCCTGTCA
GCCTCTGATACTGGAGAATACAGCTGTGAGGCACGGAATGGGTATGGGACACCCATGACT
TCAAATGCTGTGCGCATGGAAGCTGTGGAGCGGAATGTGGGGGTCATCGTGGCAGCCGTC
CTTGTAACCCTGATTCTCCTGGGAATCTTGGTTTTTGGCATCTGGTTTGCCTATAGCCGA
GGCCACTTTGACAGAACAAAGAAAGGGACTTCGAGTAAGAAGGTGATTTACAGCCAGCCT
AGTGCCCGAAGTGAAGGAGAATTCAAACAGACCTCGTCATTCCTGGTGTGAGCCTGGTCG
GCTCACCGCCTATCATCTGCATTTGCCTTACTCAGGTGCTACCGGACTCTGGCCCCTGAT
GTCTGTAGTTTCACAGGATGCCTTATTTGTCTTCTACACCCCACAGGGCCCCCTACTTCT
TCGGATGTGTTTTTAATAATGTCAGCTATGTGCCCCATCCTCCTTCATGCCCTCCCTCCC
TTTCCTACCACTGCTGAGTGGCCTGGAACTTGTTTAAAGTGTTTATTCCCCATTTCTTTG
AGGGATCAGGAAGGAATCCTGGGTATGCCATTGACTTCCCTTCTAAGTAGACAGCAAAAA
TGGCGGGGGTCGCAGGAATCTGCACTCAACTGCCCACCTGGCTGGCAGGGATCTTTGAAT
AGGTATCTTGAGCTTGGTTCTGGGCTCTTTCCTTGTGTACTGACGACCAGGGCCAGCTGT
TCTAGAGCGGGAATTAGAGGCTAGAGCGGCTGAAATGGTTGTTTGGTGATGACACTGGGG
TCCTTCCATCTCTGGGGCCCACTCTCTTCTGTCTTCCCATGGGAAGTGCCACTGGGATCC
CTCTGCCCTGTCCTCCTGAATACAAGCTGACTGACATTGACTGTGTCTGTGGAAAATGGG
AGCTCTTGTTGTGGAGAGCATAGTAAATTTTCAGAGAACTTGAAGCCAAAAGGATTTAAA
ACCGCTGCTCTAAAGAAAAGAAAACTGGAGGCTGGGCGCAGTGGCTCACGCCTGTAATCC
CAGAGGCTGAGGCAGGCGGATCACCTGAGGTCGGGAGTTCGGGATCAGCCTGACCAACAT
GGAGAAACCCTACTGGAAATACAAAGTTAGCCAGGCATGGTGGTGCATGCCTGTAGTCCC
AGCTGCTCAGGAGCCTGGCAACAAGAGCAAAACTCCAGCTCAAAAAAAAAAAAAAA
```

FIGURE 54

MGTKAQVERKLLCLFILAILLCSLALGSVTVHSSEPEVRIPENNPVKLSCAYSGFSSPRV
EWKFDQGDTTRLVCYNNKITASYEDRVTFLPTGITFKSVTREDTGTYTCMVSEEGGNSYG
EVKVKLIVLVPPSKPTVNIPSSATIGNRAVLTCSEQDGSPPSEYTWFKDGIVMPTNPKST
RAFSNSSYVLNPTTGELVFDPLSASDTGEYSCEARNGYGTPMTSNAVRMEAVERNVGVIV
AAVLVTLILLGILVFGIWFAYSRGHFDRTKKGTSSKKVIYSQPSARSEGEFKQTSSFLV

Signal sequence:
amino acids 1-27

Transmembrane domain:
amino acids 238-255

N-glycosylation site:
amino acids 185-189 cAMP- and cGMP-dependent protein kinase phosphorylation site:
amino acids 270-274

Casein kinase II phosphorylation site:
amino acids 34-38, 82-86, 100-104, 118-122, 152-156, 154-158, 193-197, 203-207, 287-291

N-myristoylation site:
amino acids 105-111, 116-122, 158-164, 219-225, 237-243, 256-262

FIGURE 55

GTTGTGTCCTTCAGCAAAACAGTGGATTTAAATCTCCTTGCACAAGCTTGAGAGCAACAC
AATCTATCAGGAAAGAAAGAAAGAAAAAAACCGAACCTGACAAAAAGAAGAAAAAGAAG
AAGAAAAAAAATCATGAAAACCATCCAGCCAAAAATGCACAATTCTATCTCTTGGGCAAT
CTTCACGGGGCTGGCTGCTCTGTGTCTCTTCCAAGGAGTGCCCGTGCGCAGCGGAGATGC
CACCTTCCCCAAAGCTATGGACAACGTGACGGTCCGGCAGGGGAGAGCGCCACCCTCAG
GTGCACTATTGACAACCGGGTCACCCGGGTGGCCTGGCTAAACCGCAGCACCATCCTCTA
TGCTGGGAATGACAAGTGGTGCCTGGATCCTCGCGTGGTCCTTCTGAGCAACACCCAAAC
GCAGTACAGCATCGAGATCCAGAACGTGGATGTGTATGACGAGGGCCCTTACACCTGCTC
GGTGCAGACAGACAACCACCCAAAGACCTCTAGGGTCCACCTCATTGTGCAAGTATCTCC
CAAAATTGTAGAGATTTCTTCAGATATCTCCATTAATGAAGGGAACAATATTAGCCTCAC
CTGCATAGCAACTGGTAGACCAGAGCCTACGGTTACTTGGAGACACATCTCTCCCAAAGC
GGTTGGCTTTGTGAGTGAAGACGAATACTTGGAAATTCAGGGCATCACCCGGGAGCAGTC
AGGGGACTACGAGTGCAGTGCCTCCAATGACGTGGCCGCGCCCGTGGTACGGAGAGTAAA
GGTCACCGTGAACTATCCACCATACATTTCAGAAGCCAAGGGTACAGGTGTCCCCGTGGG
ACAAAAGGGGACACTGCAGTGTGAAGCCTCAGCAGTCCCCTCAGCAGAATTCCAGTGGTA
CAAGGATGACAAAAGACTGATTGAAGGAAAGAAAGGGGTGAAAGTGGAAAACAGACCTTT
CCTCTCAAAACTCATCTTCTTCAATGTCTCTGAACATGACTATGGAACTACACTTGCGT
GGCCTCCAACAAGCTGGGCCACACCAATGCCAGCATCATGCTATTTGGTCCAGGCGCCGT
CAGCGAGGTGAGCAACGGCACGTCGAGGAGGGCAGGCTGCGTCTGGCTGCTGCCTCTTCT
GGTCTTGCACCTGCTTCTCAAATTTTGATGTGAGTGCCACTTCCCCACCCGGGAAGGCT
GCCGCCACCACCACCAACACAACAGCAATGGCAACACCGACAGCAACCAATCAGATA
TATACAAATGAAATTAGAAGAAACACAGCCTCATGGGACAGAAATTTGAGGGAGGGGAAC
AAAGAATACTTTGGGGGGAAAAGAGTTTTAAAAAAGAAATTGAAATTGCCTTGCAGATA
TTTAGGTACAATGGAGTTTTCTTTTCCCAAACGGGAAGAACACAGCACACCCGGCTTGGA
CCCACTGCAAGCTGCATCGTGCAACCTCTTTGGTGCCAGTGTGGGCAAGGGCTCAGCCTC
TCTGCCCACAGAGTGCCCCCACGTGGAACATTCTGGAGCTGGCCATCCCAAATTCAATCA
GTCCATAGAGACGAACAGAATGAGACCTTCCGGCCCAAGCGTGGCGCTGCGGGCACTTTG
GTAGACTGTGCCACCACGGCGTGTGTTGTGAAACGTGAAATAAAAGAGCAAAAAAAA

FIGURE 56

MKTIQPKMHNSISWAIFTGLAALCLFQGVPVRSGDATFPKAMDNVTVRQGESATLRCTID
NRVTRVAWLNRSTILYAGNDKWCLDPRVVLLSNTQTQYSIEIQNVDVYDEGPYTCSVQTD
NHPKTSRVHLIVQVSPKIVEISSDISINEGNNISLTCIATGRPEPTVTWRHISPKAVGFV
SEDEYLEIQGITREQSGDYECSASNDVAAPVVRRVKVTVNYPPYISEAKGTGVPVGQKGT
LQCEASAVPSAEFQWYKDDKRLIEGKKGVKVENRPFLSKLIFFNVSEHDYGNYTCVASNK
LGHTNASIMLFGPGAVSEVSNGTSRRAGCVWLLPLLVLHLLLKF

FIGURE 57

<u>GCT</u>GCGCCGGCTGCGGCTGCAGGGGAATCCGCTGTGGTGCGGCTGCCAGGCGCGGCCCCT
ACTCGAGTGGCTGGCGCGGGCGCGCGTGCGCTCGGACGGCGCGTGCCAGGGGCCGCGGCG
CCTGCGGGGCGAGGCTCTGGACGCCCTGCGGCCCTGGGACCTGCGCTGCCCTGGGGACGC
GGCGCAGGAAGAGGAAGAGCTGGAAGAGCGGGCTGTGGCCGGGCCCCGCGCCCCTCCGCG
CGGCCCTCCGCGCGGCCCCGGGGAGGAGCGGGCAGTCGCGCCTTGCCCTCGCGCCTGCGT
GTGCGTCCCCGAGTCCCGGCACAGCAGCTGCGAGGGCTGCGGCCTGCAGGCGGTGCCCCG
CGGCTTCCCCAGCGACACCCAGCTCCTGGACCTGAGGCGGAACCACTTCCCCTCGGTGCC
CCGAGCGGCCTTCCCCGGNCTGGGCCACCTGGTGTCGCTGCACCTGCAGCACTGCGGCAT
CGCGGAGCTGGAAGCGGGCGCCCTGGCCGGGCTGGGCCGCCTGATCTACCTGTACCTCTC
CGACAACCAGCTCGCAGGCCTCAGCGCTGCTGCCCTTGAAGGGGCTCCCCGCCTCGGCTA
CCTGTACCTAGAACGCAACCGTTTCCTGCAGGTGCCAGGGGCTGCCNTGCGCGCCCTGCC
CAGCCTCTTCTCCCTGCACCTGCAGGACAACGCTGTGGACCGCCTGGCACCTGGGGACCT
GGGGAGAACACGGGCCTTGCGCTGGGTCTACCTGAGTGGAAACCGCATCACCGAAGTGTC
CCTTGGGGCGCTGGGCCCAGCTCGGGAGCTGGAGAAGCTGCACCTGGACAGGAATCAGCT
GCGAGAGGTGCCCACTGGGGCCTTGGAGGGGCTGCCTGCCCTCCTGGAGCTGCAGCTCTC
GGGCAACCCACTCAGGGCCTTGCGTGACGGAGCCTTCCAGCCTGTGGGCAGGTCGCTGCA
GCACCTCTTCCTGAACAGCAGTGGCCTGGAGCAGATTTGTCCTGGGGCCTTTTCAGGCCT
GGGGCCCGGGCTCCAGAGCCTGCACCTGCAGAAGAACCAGCTTCGGGCCCTGCCTGCCCT
GCCCAGTCTCAGCCAGCTGGAGCTCATCGACCTCAGCAGCAATCCCTTCCCCTGTGACTG
CCAGCTGCTTCCGCTGCACAGGTGGCTTACTGGGCTGAACCTGCGGGTGGGGCCACCTG
CGCCACCCCTCCCAATGCCCGTGGCCAGAGGGTGAAGGCTGCAGCTGCTGTCTTTGAAGA
CTGCCCGGGCTGGGCTGCCAGAAAGGCCAAGCGGACACCAGCCTCCAGGCCCAGTGCCAG
GAGAACCCCCATCAAAGGAAGACAGTGTGGAGCAGATAAGAACATCCTCTTCCCCACATG
GTACCACACTGTGGAGCCCACCTCGCTGTCA<u>TAG</u>GCCTGCGGCTCTGAAGGATGGCTTTG
CCCGCTCCCGCTCTGCCCCTCAAGTGGAACCCAAGCTGGGCTCAGAATCTGTAGAGTGAG
GCCCCACCAAGGGAAACGACACCCACGGCCTGAGAGCCAGGTGGAGTCCTGCCACTCAGC
TGCCTGCCTTTGCTCCCACCCTCTCCCACCCTCAAAGAGGTCTCGAGGGGACACTCTGAA
GGCACCTGGCTCAGAACCACTGCCATCCAAGGAGCGAGGAGTCCCAGGGCTGAGCAAATG
CAGCGGGGAGGTCGGCAGTTCCCCTGCTTCCCGATCCTCATTTTCTGCTTCACTTGACTC
CTCCAGATAGGAGCTGCTCTCACTGCCCACACTGCTG

FIGURE 58

```
LRRLRLQGNPLWCGCQARPLLEWLARARVRSDGACQGPRRLRGEALDALRPWDLRCPGDA
AQEEEELEERAVAGPRAPPRGPPRGPGEERAVAPCPRACVCVPESRHSSCEGCGLQAVPR
GFPSDTQLLDLRRNHFPSVPRAAFPGLGHLVSLHLQHCGIAELEAGALAGLGRLIYLYLS
DNQLAGLSAAALEGAPRLGYLYLERNRFLQVPGAAXRALPSLFSLHLQDNAVDRLAPGDL
GRTRALRWVYLSGNRITEVSLGALGPARELEKLHLDRNQLREVPTGALEGLPALLELQLS
GNPLRALRDGAFQPVGRSLQHLFLNSSGLEQICPGAFSGLGPGLQSLHLQKNQLRALPAL
PSLSQLELIDLSSNPFPCDCQLLPLHRWLTGLNLRVGATCATPPNARGQRVKAAAAVFED
CPGWAARKAKRTPASRPSARRTPIKGRQCGADKNILFPTWYHTVEPTSLS
```

Signal sequence:
None

Transmembrane domain:
None

N-glycosylation site:
325-328

Glycosaminoglycan attachment site:
338-341

Protein kinase C phosphorylation site:
438-440

N-myristoylation site:
166-171, 186-191, 253-258, 286-291, 335-340, 339-344, 450-455

Leucine rich repeat N-terminal domain:
94-123

Leucine Rich Repeat:
125-148, 149-172, 173-196, 197-220, 221-244, 245-268, 269-292, 293-316, 318-341, 343-364, 365-386

Leucine rich repeat C-terminal domain:
374-422

FIGURE 59

```
CTCCCACGGTGTCCAGCGCCCAGAATGCGGCTTCTGGTCCTGCTATGGGGTTGCCTGCTG
CTCCCAGGTTATGAAGCCCTGGAGGGCCCAGAGGAAATCAGCGGGTTCGAAGGGGACACT
GTGTCCCTGCAGTGCACCTACAGGGAAGAGCTGAGGGACCACCGGAAGTACTGGTGCAGG
AAGGGTGGGATCCTCTTCTCTCGCTGCTCTGGCACCATCTATGCAGAAGAAGAAGGCCAG
GAGACAATGAAGGGCAGGGTGTCCATCCGTGACAGCCGCCAGGAGCTCTCGCTCATTGTG
ACCCTGTGGAACCTCACCCTGCAAGACGCTGGGGAGTACTGGTGTGGGGTCGAAAAACGG
GGCCCCGATGAGTCTTTACTGATCTCTCTGTTCGTCTTTCCAGGACCCTGCTGTCCTCCC
TCCCCTTCTCCCACCTTCCAGCCTCTGGCTACAACACGCCTGCAGCCCAAGGCAAAAGCT
CAGCAAACCCAGCCCCAGGATTGACTTCTCCTGGGCTCTACCCGGCAGCCACCACAGCC
AAGCAGGGGAAGACAGGGGCTGAGGCCCCTCCATTGCCAGGGACTTCCCAGTACGGGCAC
GAAAGGACTTCTCAGTACACAGGAACCTCTCCTCACCCAGCGACCTCTCCTCCTGCAGGG
AGCTCCCGCCCCCCATGCAGCTGGACTCCACCTCAGCAGAGGACACCAGTCCAGCTCTC
AGCAGTGGCAGCTCTAAGCCCAGGGTGTCCATCCCGATGGTCCGCATACTGGCCCCAGTC
CTGGTGCTGCTGAGCCTTCTGTCAGCCGCAGGCCTGATCGCCTTCTGCAGCCACCTGCTC
CTGTGGAGAAAGGAAGCTCAACAGGCCACGGAGACACAGAGGAACGAGAAGTTCTGGCTC
TCACGCTTGACTGCGGAGGAAAAGGAAGCCCCTTCCCAGGCCCCTGAGGGGACGTGATC
TCGATGCCTCCCCTCCACACATCTGAGGAGGAGCTGGGCTTCTCGAAGTTTGTCTCAGCG
TAGGGCAGGAGGCCCTCCTGGCCAGGCCAGCAGTGAAGCAGTATGGCTGGCTGGATCAGC
ACCGATTCCCGAAAGCTTTCCACCTCAGCCTCAGAGTCCAGCTGCCCGGACTCCAGGGCT
CTCCCCACCCTCCCCAGGCTCTCCTCTTGCATGTTCCAGCCTGACCTAGAAGCGTTTGTC
AGCCCTGGAGCCCAGAGCGGTGGCCTTGCTCTTCCGGCTGGAGACTGGGACATCCCTGAT
AGGTTCACATCCCTGGGCAGAGTACCAGGCTGCTGACCCTCAGCAGGGCCAGACAAGGCT
CAGTGGATCTGGTCTGAGTTTCAATCTGCCAGGAACTCCTGGGCCTCATGCCCAGTGTCG
GACCCTGCCTTCCTCCCACTCCAGACCCCACCTTGTCTTCCCTCCCTGGCGTCCTCAGAC
TTAGTCCCACGGTCTCCTGCATCAGCTGGTGATGAAGAGGAGCATGCTGGGGTGAGACTG
GGATTCTGGCTTCTCTTTGAACCACCTGCATCCAGCCCTTCAGGAAGCCTGTGAAAAACG
TGATTCCTGGCCCCACCAAGACCCACCAAAACCATCTCTGGGCTTGGTGCAGGACTCTGA
ATTCTAACAATGCCCAGTGACTGTCGCACTTGAGTTTGAGGGCCAGTGGGCCTGATGAAC
GCTCACACCCCTTCAGCTTAGAGTCTGCATTTGGGCTGTGACGTCTCCACCTGCCCAAT
AGATCTGCTCTGTCTGCGACACCAGATCCACGTGGGGACTCCCCTGAGGCCTGCTAAGTC
CAGGCCTTGGTCAGGTCAGGTGCACATTGCAGGATAAGCCCAGGACCGGCACAGAAGTGG
TTGCCTTTNCCATTTGCCCTCCCTGGNCCATGCCTTCTTGCCTTTGGAAAAAATGATGAA
GAAAACCTTGGCTCCTTCCTTGTCTGGAAAGGGTTACTTGCCTATGGGTTCTGGTGGCTA
GAGAGAAAAGTAGAAAACCAGAGTGCACGTAGGTGTCTAACACAGAGGAGAGTAGGAACA
GGGCGGATACCTGAAGGTGACTCCGAGTCCAGCCCCCTGGAGAAGGGGTCGGGGGTGGTG
GTAAAGTAGCACAACTACTATTTTTTTTCTTTTTCCATTATTATTGTTTTTTAAGACAGA
ATCTCGTGCTGCTGCCCAGGCTGGAGTGCAGTGGCACGATCTGCAAACTCCGCCTCCTGG
GTTCAAGTGATTCTTCTGCCTCAGCCTCCCGAGTAGCTGGGATTACAGGCACGCACCACC
ACACCTGGCTAATTTTGTACTTTTAGTAGAGATGGGGTTTCACCATGTTGGCCAGGCTG
GTCTTGAACTCCTGACCTCAAATGAGCCTCCTGCTTCAGTCTCCCAAATTGCCGGGATTA
CAGGCATGAGCCACTGTGTCTGGCCCTATTTCCTTTAAAAAGTGAAATTAAGAGTTGTTC
AGTATGCAAAACTTGGAAAGATGGAGGAGAAAAGAAAAGGAAGAAAAAAATGTCACCCA
TAGTCTCACCAGAGACTATCATTATTTCGTTTTGTTGTACTTCCTTCCACTCTTTTCTTC
TTCACATAATTTGCCGGTGTTCTTTTTACAGAGCAATTATCTTGTATATACAACTTTGTA
TCCTGCCTTTTCCACCTTATCGTTCCATCACTTTATTCCAGCACTTCTCTGTGTTTTACA
GACCTTTTTATAAATAAAATGTTCATCAGCTGCATAAAAAAAAAAAAA
```

FIGURE 60

MRLLVLLWGCLLLPGYEALEGPEEISGFEGDTVSLQCTYREELRDHRKYWCRKGGILFSR
CSGTIYAEEEGQETMKGRVSIRDSRQELSLIVTLWNLTLQDAGEYWCGVEKRGPDESLLI
SLFVFPGPCCPPSPSPTFQPLATTRLQPKAKAQQTQPPGLTSPGLYPAATTAKQGKTGAE
APPLPGTSQYGHERTSQYTGTSPHPATSPPAGSSRPPMQLDSTSAEDTSPALSSGSSKPR
VSIPMVRILAPVLVLLSLLSAAGLIAFCSHLLLWRKEAQQATETQRNEKFWLSRLTAEEK
EAPSQAPEGDVISMPPLHTSEEELGFSKFVSA

Important features:
Signal peptide:
amino acids 1-17

Transmembrane domain:
amino acids 248-269

N-glycosylation site:
amino acids 96-99

Fibrinogen beta and gamma chains C-terminal domain:
amino acids 104-113

Ig like V-type domain:
amino acids 13-128

FIGURE 61

```
CGGGCCAGCCTGGGGCGGCCGGCCAGGAACCACCCGTTAAGGTGTCTTCTCTTTAGGGAT
GGTGAGGTTGGAAAAAGACTCCTGTAACCCTCCTCCAGGATGAACCACCTGCCAGAAGAC
ATGGAGAACGCTCTCACCGGGAGCCAGAGCTCCCATGCTTCTCTGCGCAATATCCATTCC
ATCAACCCCACACAACTCATGGCCAGGATTGAGTCCTATGAAGGAAGGGAAAAGAAAGGC
ATATCTGATGTCAGGAGGACTTTCTGTTTGTTTGTCACCTTTGACCTCTTATTCGTAACA
TTACTGTGGATAATAGAGTTAAATGTGAATGGAGGCATTGAGAACACATTAGAGAAGGAG
GTGATGCAGTATGACTACTATTCTTCATATTTTGATATATTTCTTCTGGCAGTTTTTCGA
TTTAAAGTGTTAATACTTGCATATGCTGTGTGCAGACTGCGCCATTGGTGGGCAATAGCG
TTGACAACGGCAGTGACCAGTGCCTTTTACTAGCAAAAGTGATCCTTTCGAAGCTTTTC
TCTCAAGGGGCTTTTGGCTATGTGCTGCCCATCATTTCATTCATCCTTGCCTGGATTGAG
ACGTGGTTCCTGGATTTCAAAGTGTTACCTCAAGAAGCAGAAGAAGAAAACAGACTCCTG
ATAGTTCAGGATGCTTCAGAGAGGGCAGCACTTATACCTGGTGGTCTTTCTGATGGTCAG
TTTTATTCCCTCCTGAATCCGAAGCAGGATCTGAAGAAGCTGAAGAAAACAGGACAGT
GAGAAACCACTTTTAGAACTATGAGTACTACTTTTGTTAAATGTGAAAAACCCTCACAGA
AAGTCATCGAGGCAAAAGAGGCAGGCAGTGGAGTCTCCCTGTCGACAGTAAAGTTGAAA
TGGTGACGTCCACTGCTGGCTTTATTGAACAGCTAATAAAGATTTATTTATTGTAATACC
TCACAAACGTTGTACCATATCCATGCACATTTAGTTGCCTGCCTGTGGCTGGTAAGGTAA
TGTCATGATTCATCCTCTCTTCAGTGAGACTGAGCCTGATGTGTTAACAAATAGGTGAAG
AAAGTCTTGTGCTGTATTCCTAATCAAAAGACTTAATATATTGAAGTAACACTTTTTTAG
TAAGCAAGATACCTTTTTATTTCAATTCACAGAATGGAATTTTTTGTTTCATGTCTCAG
ATTTATTTTGTATTTCTTTTTTAACACTCTACATTTCCCTTGTTTTTAACTCATGCACA
TGTGCTCTTTGTACAGTTTTAAAAAGTGTAATAAAATCTGACATGTCAATGTGGCTAGTT
TTATTTTTCTTGTTTTGCATTATGTGTATGGCCTGAAGTGTTGGACTTGCAAAAGGGGAA
GAAAGGAATTGCGAATACATGTAAAATGTCACCAGACATTTGTATTATTTTTATCATGAA
ATCATGTTTTTCTCTGATTGTTCTGAAATGTTCTAAATACTCTTATTTTGAATGCACAAA
ATGACTTAAACCATTCATATCATGTTTCCTTTGCGTTCAGCCAATTTCAATTAAAATGAA
CTAAATTAAAAA
```

FIGURE 62

MNHLPEDMENALTGSQSSHASLRNIHSINPTQLMARIESYEGREKKGISDVRRTFCLFVT
FDLLFVTLLWIIELNVNGGIENTLEKEVMQYDYYSSYFDIFLLAVFRFKVLILAYAVCRL
RHWWAIALTTAVTSAFLLAKVILSKLFSQGAFGYVLPIISFILAWIETWFLDFKVLPQEA
EEENRLLIVQDASERAALIPGGLSDGQFYSPPESEAGSEEAEEKQDSEKPLLEL

Important features of the protein:
Signal peptide:
amino acids 1-20

Transmembrane domains:
amino acids 54-72, 100-118, 130-144, 146-166

N-myristoylation sites:
amino acids 14-20, 78-84, 79-85, 202-208, 217-223

FIGURE 63

```
GCGCCGGGAGCCCATCTGCCCCCAGGGGCACGGGGCGCGGGGCCGGCTCCCGCCCGGCAC
ATGGCTGCAGCCACCTCGCGCGCACCCCGAGGCGCCGCGCCCAGCTCGCCCGAGGTCCGT
CGGAGGCGCCCGGCCGCCCCGGAGCCAAGCAGCAACTGAGCGGGGAAGCGCCCGCGTCCG
GGGATCGGGATGTCCCTCCTCCTTCTCCTCTTGCTAGTTTCCTACTATGTTGGAACCTTG
GGGACTCACACTGAGATCAAGAGAGTGGCAGAGGAAAAGGTCACTTTGCCCTGCCACCAT
CAACTGGGGCTTCCAGAAAAAGACACTCTGGATATTGAATGGCTGCTACCGATAATGAA
GGGAACCAAAAAGTGGTGATCACTTACTCCAGTCGTCATGTCTACAATAACTTGACTGAG
GAACAGAAGGGCCGAGTGGCCTTTGCTTCCAATTTCCTGGCAGGAGATGCCTCCTTGCAG
ATTGAACCTCTGAAGCCCAGTGATGAGGGCCGGTACACCTGTAAGGTTAAGAATTCAGGG
CGCTACGTGTGGAGCCATGTCATCTTAAAAGTCTTAGTGAGACCATCCAAGCCCAAGTGT
GAGTTGGAAGGAGAGCTGACAGAAGGAAGTGACCTGACTTTGCAGTGTGAGTCATCCTCT
GGCACAGAGCCCATTGTGTATTACTGGCAGCGAATCCGAGAGAAAGAGGGAGAGGATGAA
CGTCTGCCTCCCAAATCTAGGATTGACTACAACCACCCTGGACGAGTTCTGCTGCAGAAT
CTTACCATGTCCTACTCTGGACTGTACCAGTGCACAGCAGGCAACGAAGCTGGGAAGGAA
AGCTGTGTGGTGCGAGTAACTGTACAGTATGTACAAAGCATCGGCATGGTTGCAGGAGCA
GTGACAGGCATAGTGGCTGGAGCCCTGCTGATTTTCCTCTTGGTGTGGCTGCTAATCCGA
AGGAAAGACAAAGAAAGATATGAGGAAGAAGAGAGACCTAATGAAATTCGAGAAGATGCT
GAAGCTCCAAAAGCCCGTCTTGTGAAACCCAGCTCCTCTTCCTCAGGCTCTCGGAGCTCA
CGCTCTGGTTCTTCCTCCACTCGCTCCACAGCAAATAGTGCCTCACGCAGCCAGCGGACA
CTGTCAACTGACGCAGCACCCCAGCCAGGGCTGGCCACCCAGGCATACAGCCTAGTGGGG
CCAGAGGTGAGAGGTTCTGAACCAAAGAAAGTCCACCATGCTAATCTGACCAAAGCAGAA
ACCACACCCAGCATGATCCCCAGCCAGAGCAGAGCCTTCCAAACGGTCTGAATTACAATG
GACTTGACTCCCACGCTTTCCTAGGAGTCAGGGTCTTTGGACTCTTCTCGTCATTGGAGC
TCAAGTCACCAGCCACACAACCAGATGAGAGGTCATCTAAGTAGCAGTGAGCATTGCACG
GAACAGATTCAGATGAGCATTTTCCTTATACAATACCAAACAAGCAAAGGATGTAAGCT
GATTCATCTGTAAAAAGGCATCTTATTGTGCCTTTAGACCAGAGTAAGGGAAAGCAGGAG
TCCAAATCTATTTGTTGACCAGGACCTGTGGTGAGAAGGTTGGGGAAAGGTGAGGTGAAT
ATACCTAAAACTTTTAATGTGGGATATTTTGTATCAGTGCTTTGATTCACAATTTTCAAG
AGGAAATGGGATGCTGTTTGTAAATTTTCTATGCATTTCTGCAAACTTATTGGATTATTA
GTTATTCAGACAGTCAAGCAGAACCCACAGCCTTATTACACCTGTCTACACCATGTACTG
AGCTAACCACTTCTAAGAAACTCCAAAAAAGGAAACATGTGTCTTCTATTCTGACTTAAC
TTCATTTGTCATAAGGTTTGGATATTAATTTCAAGGGGAGTTGAAATAGTGGGAGATGGA
GAAGAGTGAATGAGTTTCTCCCACTCTATACTAATCTCACTATTTGTATTGAGCCCAAAA
TAACTATGAAAGGAGACAAAAATTTGTGACAAAGGATTGTGAAGAGCTTTCCATCTTCAT
GATGTTATGAGGATTGTTGACAAACATTAGAAATATATAATGGAGCAATTGTGGATTTCC
CCTCAAATCAGATGCCTCTAAGGACTTTCCTGCTAGATATTTCTGGAAGGAGAAAATACA
ACATGTCATTTATCAACGTCCTTAGAAAGAATTCTTCTAGAGAAAAGGGATCTAGGAAT
GCTGAAAGATTACCCAACATACCATTATAGTCTCTTCTTTCTGAGAAAATGTGAAACCAG
AATTGCAAGACTGGGTGGACTAGAAAGGGAGATTAGATCAGTTTTCTCTTAATATGTCAA
GGAAGGTAGCCGGGCATGGTGCCAGGCACCTGTAGGAAAATCCAGCAGGTGGAGGTTGCA
GTGAGCCGAGATTATGCCATTGCACTCCAGCCTGGGTGACAGAGCGGGACTCCGTCTC
```

FIGURE 64

MSLLLLLLLLVSYYVGTLGTHTEIKRVAEEKVTLPCHHQLGLPEKDTLDIEWLLTDNEGNQ
KVVITYSSRHVYNNLTEEQKGRVAFASNFLAGDASLQIEPLKPSDEGRYTCKVKNSGRYV
WSHVILKVLVRPSKPKCELEGELTEGSDLTLQCESSSGTEPIVYYWQRIREKEGEDERLP
PKSRIDYNHPGRVLLQNLTMSYSGLYQCTAGNEAGKESCVVRVTVQYVQSIGMVAGAVTG
IVAGALLIFLLVWLLIRRKDKERYEEEERPNEIREDAEAPKARLVKPSSSSSGSRSSRSG
SSSTRSTANSASRSQRTLSTDAAPQPGLATQAYSLVGPEVRGSEPKKVHHANLTKAETTP
SMIPSQSRAFQTV

Signal sequence:
amino acids 1-16

Transmembrane domain:
amino acids 232-251

FIGURE 65

```
GTCGGGGCTGCGCGACGGCGCAGGGGCTGCGGGGAGCGCCGCGCAGGCCGTGCAGTTCCT
AGCGAGGAGGCGCCGCCGCCATTGCCGCTCTCTCGGTGAGCGCAGCCCCGCTCTCCGGGC
CGGGCCTTCGCGGGCCACCGGCGCCATGGGCCAGTGCGGCATCACCTCCTCCAAGACCGT
GCTGGTCTTTCTCAACCTCATCTTCTGGGGGGCAGCTGGCATTTTATGCTATGTGGGAGC
CTATGTCTTCATCACTTATGATGACTATGACCACTTCTTTGAAGATGTGTACACGCTCAT
CCCTGCTGTAGTGATCATAGCTGTAGGAGCCCTGCTTTTCATCATTGGGCTAATTGGCTG
CTGTGCCACAATCCGGGAAAGTCGCTGTGGACTTGCCACGTTTGTCATCATCCTGCTCTT
GGTTTTTGTCACAGAAGTTGTTGTAGTGGTTTTGGGATATGTTTACAGAGCAAAGGTGGA
AAATGAGGTTGATCGCAGCATTCAGAAAGTGTATAAGACCTACAATGGAACCAACCCTGA
TGCTGCTAGCCGGGCTATTGATTATGTACAGAGACAGCTGCATTGTTGTGGAATTCACAA
CTACTCAGACTGGGAAAATACAGATTGGTTCAAAGAAACCAAAAACCAGAGTGTCCCTCT
TAGCTGCTGCAGAGAGACTGCCAGCAATTGTAATGGCAGCCTGGCCCACCCTTCCGACCT
CTATGCTGAGGGGTGTGAGGCTCTAGTAGTGAAGAAGCTACAAGAAATCATGATGCATGT
GATCTGGGCCGCACTGGCATTTGCAGCTATTCAGCTGCTGGGCATGCTGTGTGCTTGCAT
CGTGTTGTGCAGAAGGAGTAGAGATCCTGCTTACGAGCTCCTCATCACTGGCGGAACCTA
TGCATAGTTGACAACTCAAGCCTGAGCTTTTGGTCTTGTTCTGATTTGGAAGGTGAATT
GAGCAGGTCTGCTGCTGTTGGCCTCTGGAGTTCATTTAGTTAAAGCACATGTACACTGGT
GTTGGACAGAGCAGCTTGGCTTTTCATGTGCCCACCTACTTACCTACTACCTGCGACTTT
CTTTTTCCTTGTTCTAGCTGACTCTTCATGCCCCTAAGATTTTAAGTACGATGGTGAACG
TTCTAATTTCAGAACCAATTGCGAGTCATGTAGTGTGGTAGAATTAAAGGAGGACACGAG
CCTGCTTCTGTTACCTCCAAGTGGTAACAGGACTGATGCCGAAATGTCACCAGGTCCTTT
CAGTCTTCACAGTGGAGAACTCTTGGCCAAAGGTTTTGCGGGGAGGAGGAGGAAACCAG
CTTTCTGGTTAAGGTTAACACCAGATGGTGCCCCTCATTGGTGTCCTTTTAAAAAATATT
TACTGTAGTCCAATAAGATAGCAGCTGTACAAAATGACTAAAATAGATTGTAGGATCATA
TGGCGTATATCTTGGTTCATCTTCAAAATCAGAGACTGAGCTTTGAAACTAGTGGTTTTT
AATCAAAGTTGGCTTTATAGGAGGAGTATAATGTATGCACTACTGTTTTAAAAGAATTAG
TGTGAGTGTGTTTTTGTATGAATGAGCCCATTCATGGTAAGTCTTAAGCTTGTTGGAAAT
AATGTACCCATGTAGACTAGCAAAATAGTATGTAGATGTGATCTCAGTTGTAAATAGAAA
AATCTAATTCAATAAACTCTGTATCAGCCCCAAAAAAAAAAAAAAA
```

FIGURE 66

MGQCGITSSKTVLVFLNLIFWGAAGILCYVGAYVFITYDDYDHFFEDVYTLIPAVVIIAV
GALLFIIGLIGCCATIRESRCGLATFVIILLLVFVTEVVVVVLGYVYRAKVENEVDRSIQ
KVYKTYNGTNPDAASRAIDYVQRQLHCCGIHNYSDWENTDWFKETKNQSVPLSCCRETAS
NCNGSLAHPSDLYAEGCEALVVKKLQEIMMHVIWAALAFAAIQLLGMLCACIVLCRRSRD
PAYELLITGGTYA

Signal peptide:
none

Type II transmembrane domain:
11-38

Other transmembrane domains:
48-68, 87-107, 208-235

N-glycosylation site:
127-131, 152-156, 167-171, 183-187

Tyrosine kinase phosphorylation site:
236-244

N-myristoylation site:
5-11, 68-74, 71-77, 226-232

Prokaryotic membrane lipoprotein lipid attachment site:
62-73, 221-232

Transmembrane 4 family proteins:
7-35, 56-106

FIGURE 67

GCGGCACCTGGAAG<u>ATG</u>CGCCCATTGGCTGGTGGCCTGCTCAAGGTGGTGTTCGTGGTCT
TCGCCTCCTTGTGTGCCTGGTATTCGGGGTACCTGCTCGCAGAGCTCATTCCAGATGCAC
CCCTGTCCAGTGCTGCCTATAGCATCCGCAGCATCGGGGAGAGGCCTGTCCTCAAAGCTC
CAGTCCCCAAAAGGCAAAAATGTGACCACTGGACTCCCTGCCCATCTGACACCTATGCCT
ACAGGTTACTCAGCGGAGGTGGCAGAAGCAAGTACGCCAAAATCTGCTTTGAGGATAACC
TACTTATGGGAGAACAGCTGGGAAATGTTGCCAGAGGAATAAACATTGCCATTGTCAACT
ATGTAACTGGGAATGTGACAGCAACACGATGTTTTGATATGTATGAAGGCGATAACTCTG
GACCGATGACAAAGTTTATTCAGAGTGCTGCTCCAAAATCCCTGCTCTTCATGGTGACCT
ATGACGACGGAAGCACAAGACTGAATAACGATGCCAAGAATGCCATAGAAGCACTTGGAA
GTAAAGAAATCAGGAACATGAAATTCAGGTCTAGCTGGGTATTTATTGCAGCAAAAGGCT
TGGAACTCCCTTCCGAAATTCAGAGAGAAAAGATCAACCACTCTGATGCTAAGAACAACA
GATATTCTGGCTGGCCTGCAGAGATCCAGATAGAAGGCTGCATACCCAAAGAACGAAGC<u>T</u>
<u>GA</u>CACTGCAGGGTCCTGAGTAAATGTGTTCTGTATAAACAAATGCAGCTGGAATCGCTCA
AGAATCTTATTTTTCTAAATCCAACAGCCCATATTTGATGAGTATTTTGGGTTTGTTGTA
AACCAATGAACATTTGCTAGTTGTATCAAATCTTGGTACGCAGTATTTTTATACCAGTAT
TTTATGTAGTGAAGATGTCAATTAGCAGGAAACTAAAATGAATGGAAATTCTTAAAAAAA
AAA

FIGURE 68

MRPLAGGLLKVVFVVFASLCAWYSGYLLAELIPDAPLSSAAYSIRSIGERPVLKAPVPKR
QKCDHWTPCPSDTYAYRLLSGGGRSKYAKICFEDNLLMGEQLGNVARGINIAIVNYVTGN
VTATRCFDMYEGDNSGPMTKFIQSAAPKSLLFMVTYDDGSTRLNNDAKNAIEALGSKEIR
NMKFRSSWVFIAAKGLELPSEIQREKINHSDAKNNRYSGWPAEIQIEGCIPKERS

Signal sequence:
amino acids 1-20

N-glycosylation sites:
amino acids 120-124, 208-212

Glycosaminoglycan attachment site:
amino acids 80-84

N-myristoylation sites:
amino acids 81-87, 108-114, 119-125

FIGURE 69

ACACAACTTTACACCTGAATGAACGCCAAACCTCTATGGATATATAAAGGGAAGCTTGAG
GAGGAATTTCACAGTTACAGTGCAGAAGCAGAAGCAAAAGAATTAACCAGCTCTTCAGTC
AAGCAAATCCTCTACTCACCATGCTTCCTCCTGCCATTCATTTCTATCTCCTTCCCCTTG
CATGCATCCTAATGAAAAGCTGTTTGGCTTTTAAAAATGATGCCACAGAAATCCTTTATT
CACATGTGGTTAAACCTGTTCCAGCACACCCCAGCAGCAACAGCACGTTGAATCAAGCCA
GAAATGGAGGCAGGCATTTCAGTAACACTGGACTGGATCGGAACACTCGGGTTCAAGTGG
GTTGCCGGGAACTGCGTTCCACCAAATACATCTCTGATGGCCAGTGCACCAGCATCAGCC
CTCTGAAGGAGCTGGTGTGTGCTGGCGAGTGCTTGCCCCTGCCAGTGCTCCCTAACTGGA
TTGGAGGAGGCTATGGAACAAAGTACTGGAGCAGGAGGAGCTCCCAGGAGTGGCGGTGTG
TCAATGACAAAACCCGTACCAGAGAATCCAGCTGCAGTGCCAAGATGGCAGCACACGCA
CCTACAAAATCACAGTAGTCACTGCCTGCAAGTGCAAGAGGTACACCCGGCAGCACAACG
AGTCCAGTCACAACTTTGAGAGCATGTCACCTGCCAAGCCAGTCCAGCATCACAGAGAGC
GGAAAAGAGCCAGCAAATCCAGCAAGCACAGCATGAGTTAGAACTCAGACTCCCATAACT
AGACTTACTAGTAACCATCTGCTTTACAGATTTGATTGCTTGGAAGACTCAAGCCTGCCA
CTGCTGTTTTCTCACTTGAAAGTATATGCTTTCTGCTTTGATCAAACCCAGCAAGCTGTC
TTAAGTATCAGGACCTTCTTTGGGAATAGTTTTTCCTTTTAAAGTTTTTCAAGATGTAGG
TATATCCATGAATGCAATTTGCATTTAAATTCCACGTATCCCTGTAGTTTAAATTCCTCA
TTGGTCTTAAAAGACTGTTGATACTATAAACATCAGTGGAATCAATTATATTTTAAAACA
GAAAAGGGCTT

FIGURE 70

MLPPAIHFYLLPLACILMKSCLAFKNDATEILYSHVVKPVPAHPSSNSTLNQARNGGRHF
SNTGLDRNTRVQVGCRELRSTKYISDGQCTSISPLKELVCAGECLPLPVLPNWIGGGYGT
KYWSRRSSQEWRCVNDKTRTQRIQLQCQDGSTRTYKITVVTACKCKRYTRQHNESSHNFE
SMSPAKPVQHHRERKRASKSSKHSMS

Signal sequence:
1-23

Transmembrane domain:
None

N-glycosylation site:
47-50, 173-176 cAMP- and cGMP-dependent protein kinase phosphorylation site:
125-128, 166-169, 195-198

N-myristoylation site:
64-69, 87-92, 115-120, 116-121, 150-155

FIGURE 71

CCCAGGCTCTAGTGCAGGAGGAGAAGGAGGAGGAGCAGGAGGTGGAGATTCCCAGTTAAA
AGGCTCCAGAATCGTGTACCAGGCAGAGAACTGAAGTACTGGGGCCTCCTCCACTGGGTC
CGAATCAGTAGGTGACCCCGCCCCTGGATTCTGGAAGACCTCACCATGGGACGCCCCGA
CCTCGTGCGGCCAAGACGTGGATGTTCCTGCTCTTGCTGGGGGGAGCCTGGGCAGGACAC
TCCAGGGCACAGGAGGACAAGGTGCTGGGGGGTCATGAGTGCCAACCCCATTCGCAGCCT
TGGCAGGCGGCCTTGTTCCAGGGCCAGCAACTACTCTGTGGCGGTGTCCTTGTAGGTGGC
AACTGGGTCCTTACAGCTGCCCACTGTAAAAAACCGAAATACACAGTACGCCTGGGAGAC
CACAGCCTACAGAATAAAGATGGCCCAGAGCAAGAAATACCTGTGGTTCAGTCCATCCCA
CACCCCTGCTACAACAGCAGCGATGTGGAGGACCACAACCATGATCTGATGCTTCTTCAA
CTGCGTGACCAGGCATCCCTGGGGTCCAAAGTGAAGCCCATCAGCCTGGCAGATCATTGC
ACCCAGCCTGGCCAGAAGTGCACCGTCTCAGGCTGGGGCACTGTCACCAGTCCCCGAGAG
AATTTTCCTGACACTCTCAACTGTGCAGAAGTAAAAATCTTTCCCCAGAAGAAGTGTGAG
GATGCTTACCCGGGGCAGATCACAGATGGCATGGTCTGTGCAGGCAGCAGCAAAGGGGCT
GACACGTGCCAGGGCGATTCTGGAGGCCCCCTGGTGTGTGATGGTGCACTCCAGGGCATC
ACATCCTGGGGCTCAGACCCCTGTGGGAGGTCCGACAAACCTGGCGTCTATACCAACATC
TGCCGCTACCTGGACTGGATCAAGAAGATCATAGGCAGCAAGGGCTGATTCTAGGATAAG
CACTAGATCTCCCTTAATAAACTCACAACTCTCTGGTTC

FIGURE 72

MGRPRPRAAKTWMFLLLLGGAWAGHSRAQEDKVLGGHECQPHSQPWQAALFQGQQLLCGG
VLVGGNWVLTAAHCKKPKYTVRLGDHSLQNKDGPEQEIPVVQSIPHPCYNSSDVEDHNHD
LMLLQLRDQASLGSKVKPISLADHCTQPGQKCTVSGWGTVTSPRENFPDTLNCAEVKIFP
QKKCEDAYPGQITDGMVCAGSSKGADTCQGDSGGPLVCDGALQGITSWGSDPCGRSDKPG
VYTNICRYLDWIKKIIGSKG

Important Features:
Signal peptide:
amino acids 1-23

Transmembrane domain:
amino acids 51-71

N-glycosylation site:
amino acids 110-113

Serine proteases, trypsin family, histidine active site:
amino acids 69-74 and 207-217

Tyrosine kinase phosphorylation site:
amino acids 182-188

Kringle domain proteins motif:
amino acids 205-217

FIGURE 73

CTCGGGCGCGCACAGGCAGCTCGGTTTGCCCTGCGATTGAGCTGCGGGTCGCGGCCGGCG
CCGGCCTCTCCAATGGCAAATGTGTGTGGCTGGAGGCGAGCGCGAGGCTTTCGGCAAAGG
CAGTCGAGTGTTTGCAGACCGGGGCGAGTCCTGTGAAAGCAGATAAAAGAAAACATTTAT
TAACGTGTCATTACGAGGGGAGCGCCCGGCCGGGGCTGTCGCACTCCCCGCGGAACATTT
GGCTCCCTCCAGCTCCGAGAGAGGAGAAGAAGAAAGCGGAAAGAGGCAGATTCACGTCG
TTTCCAGCCAAGTGGACCTGATCGATGGCCCTCCTGAATTTATCACGATATTTGATTTAT
TAGCGATGCCCCTGGTTTGTGTGTTACGCACACACACGTGCACACAAGGCTCTGGCTCG
CTTCCCTCCCTCGTTTCCAGCTCCTGGGCGAATCCCACATCTGTTTCAACTCTCCGCCGA
GGGCGAGCAGGAGCGAGAGTGTGTCGAATCTGCGAGTGAAGAGGGACGAGGGAAAAGAAA
CAAAGCCACAGACGCAACTTGAGACTCCGCATCCCAAAAGAAGCACCAGATCAGCAAAA
AAAGAAG<u>ATG</u>GGCCCCCCGAGCCTCGTGCTGTGCTTGCTGTCCGAACTGTGTTCTCCCT
GCTGGGTGGAAGCTCGGCCTTCCTGTCGCACCACCGCCTGAAAGGCAGGTTTCAGAGGGA
CCGCAGGAACATCCGCCCCAACATCATCCTGGTGCTGACGGACGACCAGGATGTGGAGCT
GGGTTCCATGCAGGTGATGAACAAGACCCGGCGCATCATGGAGCAGGGCGGGGCGCACTT
CATCAACGCCTTCGTGACCACACCCATGTGCTGCCCCTCACGCTCCTCCATCCTCACTGG
CAAGTACGTCCACAACCACAACACCTACACCAACAATGAGAACTGCTCCTCGCCCTCCTG
GCAGGCACAGCACGAGAGCCGCACCTTTGCCGTGTACCTCAATAGCACTGGCTACCGGAC
AGCTTTCTTCGGGAAGTATCTTAATGAATACAACGGCTCCTACGTGCCACCCGGCTGGAA
GGAGTGGGTCGGACTCCTTAAAAACTCCCGCTTTTATAACTACACGCTGTGTCGGAACGG
GGTGAAAGAGAAGCACGGCTCCGACTACTCCAAGGATTACCTCACAGACCTCATCACCAA
TGACAGCGTGAGCTTCTTCCGCACGTCCAAGAAGATGTACCCGCACAGGCCAGTCCTCAT
GGTCATCAGCCATGCAGCCCCCACGGCCCTGAGGATTCAGCCCCACAATATTCACGCCT
CTTCCCAAACGCATCTCAGCACATCACGCCGAGCTACAACTACGCGCCCAACCCGGACAA
ACACTGGATCATGCGCTACACGGGGCCCATGAAGCCCATCCACATGGAATTCACCAACAT
GCTCCAGCGGAAGCGCTTGCAGACCCTCATGTCGGTGGACGACTCCATGGAGACGATTTA
CAACATGCTGGTTGAGACGGGCGAGCTGGACAACACGTACATCGTATACACCGCCGACCA
CGGTTACCACATCGGCCAGTTTGGCCTGGTGAAAGGGAAATCCATGCCATATGAGTTTGA
CATCAGGGTCCCGTTCTACGTGAGGGGCCCCAACGTGGAAGCCGGCTGTCTGAATCCCCA
CATCGTCCTCAACATTGACCTGGCCCCCACCATCCTGGACATTGCAGGCCTGGACATACC
TGCGGATATGGACGGGAAATCCATCCTCAAGCTGCTGGACACGGAGCGGCCGGTGAATCG
GTTTCACTTGAAAAAGAAGATGAGGGTCTGGCGGGACTCCTTCTTGGTGGAGAGAGGCAA
GCTGCTACACAAGAGAGACAATGACAAGGTGGACGCCCAGGAGGAGAACTTTCTGCCCAA
GTACCAGCGTGTGAAGGACCTGTGTCAGCGTGCTGAGTACCAGACGGCGTGTGAGCAGCT
GGGACAGAAGTGGCAGTGTGTGGAGGACGCCACGGGGAAGCTGAAGCTGCATAAGTGCAA
GGGCCCCATGCGGCTGGGCGGCAGCAGAGCCCTCTCCAACCTCGTGCCCAAGTACTACGG
GCAGGGCAGCGAGGCCTGCACCTGTGACAGCGGGGACTACAAGCTCAGCCTGGCCGGACG
CCGGAAAAACTCTTCAAGAAGAAGTACAAGGCCAGCTATGTCCGCAGTCGCTCCATCCG
CTCAGTGGCCATCGAGGTGGACGGCAGGGTGTACCACGTAGGCCTGGGTGATGCCGCCCA
GCCCCGAAACCTCACCAAGCGGCACTGGCCAGGGGCCCCTGAGGACCAAGATGACAAGGA
TGGTGGGGACTTCAGTGGCACTGGAGGCCTTCCCGACTACTCAGCCGCCAACCCCATTAA
AGTGACACATCGGTGCTACATCCTAGAGAACGACACAGTCCAGTGTGACCTGGACCTGTA
CAAGTCCCTGCAGGCCTGGAAAGACCACAAGCTGCACATCGACCACGAGATTGAAACCCT
GCAGAACAAAATTAAGAACCTGAGGGAAGTCCGAGGTCACCTGAAGAAAAGCGGCCAGA
AGAATGTGACTGTCACAAAATCAGCTACCACACCCAGCACAAAGGCCGCCTCAAGCACAG
AGGCTCCAGTCTGCATCCTTTCAGGAAGGGCCTGCAAGAGAAGGACAAGGTGTGGCTGTT
GCGGGAGCAGAAGCGCAAGAAGAAACTCCGCAAGCTGCTCAAGCGCCTGCAGAACAACGA
CACGTGCAGCATGCCAGGCCTCACGTGCTTCACCCACGACAACCAGCACTGGCAGACGGC

FIGURE 73
(continued)

```
GCCTTTCTGGACACTGGGGCCTTTCTGTGCCTGCACCAGCGCCAACAATAACACGTACTG
GTGCATGAGGACCATCAATGAGACTCACAATTTCCTCTTCTGTGAATTTGCAACTGGCTT
CCTAGAGTACTTTGATCTCAACACAGACCCCTACCAGCTGATGAATGCAGTGAACACACT
GGACAGGGATGTCCTCAACCAGCTACACGTACAGCTCATGGAGCTGAGGAGCTGCAAGGG
TTACAAGCAGTGTAACCCCCGGACTCGAAACATGGACCTGGATGGAGGAAGCTATGAGCA
ATACAGGCAGTTTCAGCGTCGAAAGTGGCCAGAAATGAAGAGACCTTCTTCCAAATCACT
GGGACAACTGTGGGAAGGCTGGGAAGGTTAAGAAACAACAGAGGTGGACCTCCAAAAACA
TAGAGGCATCACCTGACTGCACAGGCAATGAAAAACCATGTGGGTGATTTCCAGCAGACC
TGTGCTATTGGCCAGGAGGCCTGAGAAAGCAAGCACGCACTCTCAGTCAACATGACAGAT
TCTGGAGGATAACCAGCAGGAGCAGAGATAACTTCAGGAAGTCCATTTTTGCCCCTGCTT
TTGCTTTGGATTATACCTCACCAGCTGCACAAAATGCATTTTTTCGTATCAAAAAGTCAC
CACTAACCCTCCCCCAGAAGCTCACAAAGGAAAACGGAGAGAGCGAGCGAGAGAGATTTC
CTTGGAAATTTCTCCCAAGGGCGAAAGTCATTGGAATTTTTAAATCATAGGGGAAAAGCA
GTCCTGTTCTAAATCCTCTTATTCTTTTGGTTTGTCACAAAGAAGGAACTAAGAAGCAGG
ACAGAGGCAACGTGGAGAGGCTGAAAACAGTGCAGAGACGTTTGACAATGAGTCAGTAGC
ACAAAAGAGATGACATTTACCTAGCACTATAAACCCTGGTTGCCTCTGAAGAAACTGCCT
TCATTGTATATATGTGACTATTTACATGTAATCAACATGGGAACTTTTAGGGGAACCTAA
TAAGAAATCCCAATTTTCAGGAGTGGTGGTGTCAATAAACGCTCTGTGGCCAGTGTAAAA
GAAAAA
```

FIGURE 74

```
MGPPSLVLCLLSATVFSLLGGSSAFLSHHRLKGRFQRDRRNIRPNIILVLTDDQDVELGS
MQVMNKTRRIMEQGGAHFINAFVTTPMCCPSRSSILTGKYVHNHNTYTNNENCSSPSWQA
QHESRTFAVYLNSTGYRTAFFGKYLNEYNGSYVPPGWKEWVGLLKNSRFYNYTLCRNGVK
EKHGSDYSKDYLTDLITNDSVSFFRTSKKMYPHRPVLMVISHAAPHGPEDSAPQYSRLFP
NASQHITPSYNYAPNPDKHWIMRYTGPMKPIHMEFTNMLQRKRLQTLMSVDDSMETIYNM
LVETGELDNTYIVYTADHGYHIGQFGLVKGKSMPYEFDIRVPFYVRGPNVEAGCLNPHIV
LNIDLAPTILDIAGLDIPADMDGKSILKLLDTERPVNRFHLKKKMRVWRDSFLVERGKLL
HKRDNDKVDAQEENFLPKYQRVKDLCQRAEYQTACEQLGQKWQCVEDATGKLKLHKCKGP
MRLGGSRALSNLVPKYYGQGSEACTCDSGDYKLSLAGRRKKLFKKKYKASYVRSRSIRSV
AIEVDGRVYHVGLGDAAQPRNLTKRHWPGAPEDQDDKDGGDFSGTGGLPDYSAANPIKVT
HRCYILENDTVQCDLDLYKSLQAWKDHKLHIDHEIETLQNKIKNLREVRGHLKKKRPEEC
DCHKISYHTQHKGRLKHRGSSLHPFRKGLQEKDKVWLLREQKRKKKLRKLLKRLQNNDTC
SMPGLTCFTHDNQHWQTAPFWTLGPFCACTSANNNTYWCMRTINETHNFLFCEFATGFLE
YFDLNTDPYQLMNAVNTLDRDVLNQLHVQLMELRSCKGYKQCNPRTRNMDLDGGSYEQYR
QFQRRKWPEMKRPSSKSLGQLWEGWEG

Important features:
Signal peptide:
amino acids 1-17

Sulfatases signature 1:
amino acids 86-99

Homologous region to sulfatase:
amino acids 87-106, 133-146, 216-229, 291-320, 365-375

N-glycosylation sites:
amino acids 65-69, 112-116, 132-136, 149-153, 171-175,
198-202, 241-245, 561-565, 608-612, 717-721, 754-758,
764-768
```

FIGURE 75

```
CCCACGCGTCCGCCCACGCGTCCGGTGGACTATGGGCCAGTTTTTGTGCAAGAACCAGAT
GATATTATTTTTCCAACTGATTCTGATGAAAAGAAGGTAGCATTGAATTGTGAAGTTCGT
GGCAATCCAGTTCCCAGTTACAGATGGCTTCGAAATGGAACAGAAATAGATCTGGAAAGT
GATTATCGCTACAGTTTGATAGATGGCACCTTCATTATAAGCAATCCAAGTGAAGCAAAG
GATTCTGGTCATTATCAGTGTTTAGCAACCAACACTGTGGGGAGTATTCTTAGTAGAGAA
GCTACACTGCAGTTTGCCTATCTGGGAAATTTTAGTGGCCGGACAAGAAGTGCAGTCTCT
GTGAGGGAAGGCCAGGGTGTCGTTCTGATGTGCTCTCCTCCGCCACATTCACCAGAGATC
ATCTATAGCTGGGTATTTAATGAGTTCCCTTCCTTTGTGGCGGAAGACAGCCGGCGGTTC
ATCTCCCAGGAGACAGGCAACCTTTATATTTCTAAAGTCCAAACATCAGATGTTGGCAGC
TATATTTGTCTGGTGAAAAACACAGTGACGAATGCTAGAGTCCTTAGTCCTCCAACGCCA
CTCACTCTGCGTAATGATGGTGTGATGGGAGAATATGAGCCGAAAATTGAGGTCCATTTT
CCTTTCACGGTTACAGCTGCTAAAGGAACAACTGTTAAGATGGAATGCTTTGCACTTGGC
AACCCCGTTCCAACAATCACATGGATGAAGGTTAATGGTTATATTCCTAGTAAGGCACGT
CTGCGGAAATCTCAGGCGGTGCTGGAAATACCGAATGTACAGCTGGATGATGCAGGCATT
TATGAGTGCAGAGCTGAAAACTCACGTGGAAAAAATTCCTTTCGTGGACAATTACAAGTA
TACACCTACCCACACTGGGTAGAAAAACTGAATGATACTCAGTTAGACAGTGGGAGCCCT
CTCCGATGGGAATGTAAGGCTACTGGAAAACCCAGACCCACGTATCGTTGGCTGAAGAAT
GGAGTACCCCTCTCACCTCAGAGTAGGGTTGAGATGGTTAATGGAGTATTGATGATCCAC
AATGTGAATCAATCAGATGCTGGAATGTATCAGTGTTTGGCTGAAAATAAGTATGGAGCC
ATTTACGCTAGTGCTGAGCTGAAGATTCTAGCTTCAGCTCCCACTTTTGCACTGAATCAA
CTGAAGAAAACAATAATTGTTACCAAAGACCAAGAAGTTGTCATAGAGTGCAAACCCCAA
GGCTCTCCAAAACCAACCATCTCTTGGAAGAAAGGAGACAGAGCAGTTAGAGAAAACAAA
AGAATAGCTATTCTTCCAGACGGGAGTCTACGGATCCTAAATGCTTCCAAATCAGACGAG
GGAAAGTACGTTTGCCGAGGGGAAAACGTCTTTGGTTCTGCTGAAAT
```

FIGURE 76

```
MCSPPPHSPEIIYSWVFNEFPSFVAEDSRRFISQETGNLYISKVQTSDVGSYICLVKNTV
TNARVLSPPTPLTLRNDGVMGEYEPKIEVHFPFTVTAAKGTTVKMECFALGNPVPTITWM
KVNGYIPSKARLRKSQAVLEIPNVQLDDAGIYECRAENSRGKNSFRGQLQVYTYPHWVEK
LNDTQLDSGSPLRWECKATGKPRPTYRWLKNGVPLSPQSRVEMVNGVLMIHNVNQSDAGM
YQCLAENKYGAIYASAELKILASAPTFALNQLKKTIIVTKDQEVVIECKPQGSPKPTISW
KKGDRAVRENKRIAILPDGSLRILNASKSDEGKYVCRGENVFGSAE
```

Signal sequence:
None

Transmembrane domain:
None

N-glycosylation site:
182-185, 234-237, 325-328

Tyrosine kinase phosphorylation site:
328-334

N-myristoylation site:
50-55, 150-155, 239-244, 250-255

Immunoglobulin domain:
2-56, 100-156, 189-245, 281-338

FIGURE 77

```
GCTCCCAGCCAAGAACCTCGGGGCCGCTGCGCGGTGGGGAGGAGTTCCCCGAAACCCGGC
CGCTAAGCGAGGCCTCCTCCTCCCGCAGATCCGAACGGCCTGGGCGGGGTCACCCCGGCT
GGGACAAGAAGCCGCCGCCTGCCTGCCCGGGCCCGGGGAGGGGCTGGGGCTGGGGCCGG
AGGCGGGGTGTGAGTGGGTGTGTGCGGGGGCGGAGGCTTGATGCAATCCCGATAAGAAA
TGCTCGGGTGTCTTGGGCACCTACCCGTGGGGCCCGTAAGGCGCTACTATATAAGGCTGC
CGGCCCGGAGCCGCCGCGCCGTCAGAGCAGGAGCGCTGCGTCCAGGATCTAGGGCCACGA
CCATCCCAACCCGGCACTCACAGCCCCGCAGCGCATCCCGGTCGCCGCCCAGCCTCCCGC
ACCCCCATCGCCGGAGCTGCGCCGAGAGCCCCAGGGAGGTGCCATGCGGAGCGGGTGTGT
GGTGGTCCACGTATGGATCCTGGCCGGCCTCTGGCTGGCCGTGGCCGGGCGCCCCTCGC
CTTCTCGGACGCGGGGCCCCACGTGCACTACGGCTGGGGCGACCCCATCCGCCTGCGGCA
CCTGTACACCTCCGGCCCCCACGGGCTCTCCAGCTGCTTCCTGCGCATCCGTGCCGACGG
CGTCGTGGACTGCGCGCGGGGCCAGAGCGCGCACAGTTTGCTGGAGATCAAGGCAGTCGC
TCTGCGGACCGTGGCCATCAAGGGCGTGCACAGCGTGCGGTACCTCTGCATGGGCGCCGA
CGGCAAGATGCAGGGCTGCTTCAGTACTCGGAGGAAGACTGTGCTTTCGAGGAGGAGAT
CCGCCCAGATGGCTACAATGTGTACCGATCCGAGAAGCACCGCCTCCCGGTCTCCCTGAG
CAGTGCCAAACAGCGGCAGCTGTACAAGAACAGAGGCTTTCTTCCACTCTCTCATTTCCT
GCCCATGCTGCCCATGGTCCCAGAGGAGCCTGAGGACCTCAGGGGCCACTTGGAATCTGA
CATGTTCTCTTCGCCCCTGGAGACCGACAGCATGGACCCATTTGGGCTTGTCACCGGACT
GGAGGCCGTGAGGAGTCCCAGCTTTGAGAAGTAACTGAGACCATGCCCGGGCCTCTTCAC
TGCTGCCAGGGGCTGTGGTACCTGCAGCGTGGGGGACGTGCTTCTACAAGAACAGTCCTG
AGTCCACGTTCTGTTTAGCTTTAGGAAGAAACATCTAGAAGTTGTACATATTCAGAGTTT
TCCATTGGCAGTGCCAGTTTCTAGCCAATAGACTTGTCTGATCATAACATTGTAAGCCTG
TAGCTTGCCCAGCTGCTGCCTGGGCCCCATTCTGCTCCCTCGAGGTTGCTGGACAAGCT
GCTGCACTGTCTCAGTTCTGCTTGAATACCTCCATCGATGGGGAACTCACTTCCTTTGGA
AAAATTCTTATGTCAAGCTGAAATTCTCTAATTTTTTCTCATCACTTCCCCAGGAGCAGC
CAGAAGACAGGCAGTAGTTTTAATTTCAGGAACAGGTGATCCACTCTGTAAAACAGCAGG
TAAATTTCACTCAACCCCATGTGGGAATTGATCTATATCTCTACTTCCAGGGACCATTTG
CCCTTCCCAAATCCCTCCAGGCCAGAACTGACTGGAGCAGGCATGGCCCACCAGGCTTCA
GGAGTAGGGGAAGCCTGGAGCCCCACTCCAGCCCTGGGACAACTTGAGAATTCCCCCTGA
GGCCAGTTCTGTCATGGATGCTGTCCTGAGAATAACTTGCTGTCCCGGTGTCACCTGCTT
CCATCTCCCAGCCCACCAGCCCTCTGCCCACCTCACATGCCTCCCCATGGATTGGGGCCT
CCCAGGCCCCCACCTTATGTCAACCTGCACTTCTTGTTCAAAAATCAGGAAAAGAAAAG
ATTTGAAGACCCCAAGTCTTGTCAATAACTTGCTGTGTGGAAGCAGCGGGGGAAGACCTA
GAACCCTTTCCCCAGCACTTGGTTTTCCAACATGATATTTATGAGTAATTTATTTTGATA
TGTACATCTCTTATTTTCTTACATTATTTATGCCCCAAATTATATTTATGTATGTAAGT
GAGGTTTGTTTTGTATATTAAAATGGAGTTTGTTTGT
```

FIGURE 78

MRSGCVVVHVWILAGLWLAVAGRPLAFSDAGPHVHYGWGDPIRLRHLYTSGPHGLSSCFL
RIRADGVVDCARGQSAHSLLEIKAVALRTVAIKGVHSVRYLCMGADGKMQGLLQYSEEDC
AFEEEIRPDGYNVYRSEKHRLPVSLSSAKQRQLYKNRGFLPLSHFLPMLPMVPEEPEDLR
GHLESDMFSSPLETDSMDPFGLVTGLEAVRSPSFEK

Signal peptide:
amino acids 1-22

Casein kinase II phosphorylation site:
amino acids 78-82, 116-120, 190-194, 204-208

N-myristoylation site:
amino acids 15-21, 54-60, 66-72, 201-207

Prokaryotic membrane lipoprotein lipid attachment site:
amino acids 48-59

FIGURE 79

```
CGGACGCGTGGGCGGACGCGTGGGCCTGGGCAAGGGCCGGGGCGCCGGGCCGAGCCACCTCTTCCC
CTCCCCCGCTTCCCTGTCGCGCTCCGCTGGCTGGACGCGCTGGAGGAGTGGAGCAGCACCCGGCCG
GCCCTGGGGGCTGACAGTCGGCAAAGTTTGGCCCGAAGAGGAAGTGGTCTCAAACCCCGGCAGGTG
GCGACCAGGCCAGACCAGGGGCGCTCGCTGCCTGCGGGCGGGCTGTAGGCGAGGGCGCGCCCCAGT
GCCGAGACCCGGGGCTTCAGGAGCCGGCCCCGGGAGAGAAGAGTGCGGCGGCGGACGGAGAAAACA
ACTCCAAAGTTGGCGAAAGGCACCGCCCCTACTCCCGGGCTGCCGCCGCCTCCCCGCCCCAGCCC
TGGCATCCAGAGTACGGGTCGAGCCCGGCCATGGAGCCCCCTGGGGAGGCGGCACCAGGGAGCC
TGGGCGCCCGGGGCTCCGCCGCGACCCCATCGGGTAGACCACAGAAGCTCCGGGACCCTTCCGGCA
CCTCTGGACAGCCCAGGATGCTGTTGGCCACCCTCCTCCTCCTCCTCCTTGGAGGCGCTCTGGCCC
ATCCAGACCGGATTATTTTTCCAAATCATGCTTGTGAGGACCCCCAGCAGTGCTCTTAGAAGTGC
AGGGCACCTTACAGAGGCCCCTGGTCCGGGACAGCCGCACCTCCCCTGCCAACTGCACCTGGCTCA
TCCTGGGCAGCAAGGAACAGACTGTCACCATCAGGTTCCAGAAGCTACACCTGGCCTGTGGCTCAG
AGCGCTTAACCCTACGCTCCCCTCTCCAGCCACTGATCTCCCTGTGTGAGGCACCTCCCAGCCCTC
TGCAGCTGCCCGGGGCAACGTCACCATCACTTACAGCTATGCTGGGGCCAGAGCACCCATGGGCC
AGGGCTTCCTGCTCTCCTACAGCCAAGATTGGCTGATGTGCCTGCAGGAAGAGTTTCAGTGCCTGA
ACCACCGCTGTGTATCTGCTGTCCAGCGCTGTGATGGGGTTGATGCCTGTGGCGATGGCTCTGATG
AAGCAGGTTGCAGCTCAGACCCCTTCCCTGGCCTGACCCCAAGACCCGTCCCCTCCCTGCCTTGCA
ATGTCACCTTGGAGGACTTCTATGGGGTCTTCTCCTCTCCTGGATATACACACCTAGCCTCAGTCT
CCCACCCCAGTCCTGCCATTGGCTGCTGGACCCCATGATGGCCGGCGGCTGGCCGTGCGCTTCA
CAGCCCTGGACTTGGGCTTTGGAGATGCAGTGCATGTGTATGACGGCCCTGGGCCCCCTGAGAGCT
CCCGACTACTGCGTAGTCTCACCCACTTCAGCAATGGCAAGGCTGTCACTGTGGAGACACTGTCTG
GCCAGGCTGTTGTGTCCTACCACACAGTTGCTTGGAGCAATGGTCGTGGCTTCAATGCCACCTACC
ATGTGCGGGGCTATTGCTTGCCTTGGGACAGACCCTGTGGCTTAGGCTCTGGCCTGGGAGCTGGCG
AAGGCCTAGGTGAGCGCTGCTACAGTGAGGCACAGCGCTGTGACGGCTCATGGGACTGTGCTGACG
GCACAGATGAGGAGGACTGCCCAGGCTGCCCACCTGGACACTTCCCCTGTGGGGCTGCTGGCACCT
CTGGTGCCACAGCCTGCTACCTGCCTGCTGACCGCTGCAACTACCAGACTTTCTGTGCTGATGGAG
CAGATGAGAGACGCTGTCGGCATTGCCAGCCTGGCAATTTCCGATGCCGGGACGAGAAGTGCGTGT
ATGAGACGTGGGTGTGCGATGGGCAGCCAGACTGTGCGGACGGCAGTGATGAGTGGGACTGCTCCT
ATGTTCTGCCCCGCAAGGTCATTACAGCTGCAGTCATTGGCAGCCTAGTGTGCGGCCTGCTCCTGG
TCATCGCCCTGGGCTGCACCTGCAAGCTCTATGCCATTCGCACCCAGGAGTACAGCATCTTTGCCC
CCCTCTCCCGGATGGAGGCTGAGATTGTGCAGCAGCAGGCACCCCCTTCCTACGGGCAGCTCATTG
CCCAGGGTGCCATCCCACCTGTAGAAGACTTTCCTACAGAGAATCCTAATGATAACTCAGTGCTGG
GCAACCTGCGTTCTCTGCTACAGATCTTACGCCAGGATATGACTCCAGGAGGTGGCCCAGGTGCCC
GCCGTCGTCAGCGGGGCCGCTTGATGCGACGCCTGGTACGCCGTCTCCGCCGCTGGGGCTTGCTCC
CTCGAACCAACACCCCGGCTCGGGCCTCTGAGGCCAGATCCCAGGTCACACCTTCTGCTGCTCCCC
TTGAGGCCCTAGATGGTGGCACAGGTCCAGCCCGTGAGGGCGGGGCAGTGGGTGGGCAAGATGGGG
AGCAGGCACCCCACTGCCCATCAAGGCTCCCCTCCCATCTGCTAGCACGTCTCCAGCCCCCACTA
CTGTCCCTGAAGCCCCAGGGCCACTGCCCTCACTGCCCCTAGAGCCATCACTATTGTCTGGAGTGG
TGCAGGCCCTGCGAGGCCGCCTGTTGCCCAGCCTGGGCCCCCAGGACCAACCCGGAGCCCCCTG
GACCCCACACAGCAGTCCTGGCCCTGGAAGATGAGGACGATGTGCTACTGGTGCCACTGGCTGAGC
CGGGGGTGTGGGTAGCTGAGGCAGAGGATGAGCCACTGCTTACCTGAGGGACCTGGGGCTCTAC
TGAGGCCTCTCCCCTGGGGCTCTACTCATAGTGGCACAACCTTTTAGAGGTGGGTCAGCCTCCCC
TCCACCACTTCCTTCCCTGTCCCTGGATTTCAGGGACTTGGTGGGCCTCCCGTTGACCCTATGTAG
CTGCTATAAAGTTAAGTGTCCCTCAGGCAGGGAGAGGGCTCACAGAGTCTCCTCTGTACGTGGCCA
TGGCCAGACACCCCAGTCCCTTCACCACCACCTGCTCCCCACGCCACCACCATTTGGGTGGCTGTT
TTTAAAAAGTAAAGTTCTTAGAGGATCATAGGTCTGGACACTCCATCCTTGCCAAACCTCTACCCA
AAAGTGGCCTTAAGCACCGGAATGCCAATTAACTAGAGACCCTCCAGCCCCCAAGGGGAGGATTTG
GGCAGAACCTGAGGTTTTGCCATCCACAATCCCTCCTACAGGGCCTGGCTCACAAAAAGAGTGCAA
CAAATGCTTCTATTCCATAGCTACGGCATTGCTCAGTAAGTTGAGGTCAAAAATAAAGGAATCATA
CATCTC
```

FIGURE 80

MLLATLLLLLLGGALAHPDRIIFPNHACEDPPAVLLEVQGTLQRPLVRDSRTSPANCTWL
ILGSKEQTVTIRFQKLHLACGSERLTLRSPLQPLISLCEAPPSPLQLPGGNVTITYSYAG
ARAPMGQGFLLSYSQDWLMCLQEEFQCLNHRCVSAVQRCDGVDACGDGSDEAGCSSDPFP
GLTPRPVPSLPCNVTLEDFYGVFSSPGYTHLASVSHPQSCHWLLDPHDGRRLAVRFTALD
LGFGDAVHVYDGPGPPESSRLLRSLTHFSNGKAVTVETLSGQAVVSYHTVAWSNGRGFNA
TYHVRGYCLPWDRPCGLGSGLGAGEGLGERCYSEAQRCDGSWDCADGTDEEDCPGCPPGH
FPCGAAGTSGATACYLPADRCNYQTFCADGADERRCRHCQPGNFRCRDEKCVYETWVCDG
QPDCADGSDEWDCSYVLPRKVITAAVIGSLVCGLLLVIALGCTCKLYAIRTQEYSIFAPL
SRMEAEIVQQQAPPSYGQLIAQGAIPPVEDFPTENPNDNSVLGNLRSLLQILRQDMTPGG
GPGARRRQRGRLMRRLVRRLRRWGLLPRTNTPARASEARSQVTPSAAPLEALDGGTGPAR
EGGAVGGQDGEQAPPLPIKAPLPSASTSPAPTTVPEAPGPLPSLPLEPSLLSGVVQALRG
RLLPSLGPPGPTRSPPGPHTAVLALEDEDDVLLVPLAEPGVWVAEAEDEPLLT

Important features:
Signal peptide:
amino acids 1-16

Transmembrane domain:
amino acids 442-462

LDL-receptor class A (LDLRA) domain proteins:
amino acids 411-431, 152-171, 331-350 and 374-393

FIGURE 81

```
CTTCTGTGCTGTTCCTTCTTGCCTCTAACTTGTAAACAAGACGTACTAGGACGATGCTAA
TGGAAAGTCACAAACCGCTGGGTTTTTGAAAGGATCCTTGGGACCTCATGCACATTTGTG
GAAACTGGATGGAGAGATTTGGGGAAGCATGGACTCTTTAGCCAGCTTAGTTCTCTGTGG
AGTCAGCTTGCTCCTTTCTGGAACTGTGGAAGGTGCCATGGACTTGATCTTGATCAATTC
CCTACCTCTTGTATCTGATGCTGAAACATCTCACCTGCATTGCCTCTGGGTGGCGCCC
CCATGAGCCCATCACCATAGGAAGGGACTTTGAAGCCTTAATGAACCAGCACCAGGATCC
GCTGGAAGTTACTCAAGATGTGACCAGAGAATGGGCTAAAAAGTTGTTTGGAAGAGAGA
AAAGGCTAGTAAGATCAATGGTGCTTATTTCTGTGAAGGGCGAGTTCGAGGAGAGGCAAT
CAGGATACGAACCATGAAGATGCGTCAACAAGCTTCCTTCCTACCAGCTACTTTAACTAT
GACTGTGGACAAGGGAGATAACGTGAACATATCTTTCAAAAAGGTATTGATTAAAGAAGA
AGATGCAGTGATTTACAAAAATGGTTCCTTCATCCATTCAGTGCCCCGGCATGAAGTACC
TGATATTCTAGAAGTACACCTGCCTCATGCTCAGCCCCAGGATGCTGGAGTGTACTCGGC
CAGGTATATAGGAGGAAACCTCTTCACCTCGGCCTTCACCAGGCTGATAGTCCGGAGATG
TGAAGCCCAGAAGTGGGGACCTGAATGCAACCATCTCTGTACTGCTTGTATGAACAATGG
TGTCTGCCATGAAGATACTGGAGAATGCATTTGCCCTCCTGGGTTTATGGGAAGGACGTG
TGAGAAGGCTTGTGAACTGCACACGTTTGGCAGAACTTGTAAAGAAAGGTGCAGTGGACA
AGAGGGATGCAAGTCTTATGTGTTCTGTCTCCCTGACCCCTATGGGTGTTCCTGTGCCAC
AGGCTGGAAGGGTCTGCAGTGCAATGAAGCATGCCACCCTGGTTTTTACGGGCCAGATTG
TAAGCTTAGGTGCAGCTGCAACAATGGGGAGATGTGTGATCGCTTCCAAGGATGTCTCTG
CTCTCCAGGATGGCAGGGGCTCCAGTGTGAGAGAGAAGGCATACCGAGGATGACCCCAAA
GATAGTGGATTTGCCAGATCATATAGAAGTAAACAGTGGTAAATTTAATCCCATTTGCAA
AGCTTCTGGCTGGCCGCTACCTACTAATGAAGAAATGACCCTGGTGAAGCCGGATGGGAC
AGTGCTCCATCCAAAAGACTTTAACCATACGGATCATTTCTCAGTAGCCATATTCACCAT
CCACCGGATCCTCCCCCCTGACTCAGGAGTTTGGGTCTGCAGTGTGAACACAGTGGCTGG
GATGGTGGAAAAGCCCTTCAACATTTCTGTTAAAGTTCTTCCAAAGCCCCTGAATGCCCC
AAACGTGATTGACACTGGACATAACTTTGCTGTCATCAACATCAGCTCTGAGCCTTACTT
TGGGGATGGACCAATCAAATCCAAGAAGCTTCTATACAAACCCGTTAATCACTATGAGGC
TTGGCAACATATTCAAGTGACAAATGAGATTGTTACACTCAACTATTTGGAACCTCGGAC
AGAATATGAACTCTGTGTGCAACTGGTCCGTCGTGGAGAGGGTGGGGAAGGGCATCCTGG
ACCTGTGAGACGCTTCACAACAGCTTCTATCGGACTCCCTCCTCCAAGAGGTCTAAATCT
CCTGCCTAAAAGTCAGACCACTCTAAATTTGACCTGGCAACCAATATTTCCAAGCTCGGA
AGATGACTTTTATGTTGAAGTGGAGAGAAGGTCTGTGCAAAAAAGTGATCAGCAGAATAT
TAAAGTTCCAGGCAACTTGACTTCGGTGCTACTTAACAACTTACATCCCAGGGAGCAGTA
CGTGGTCCGAGCTAGAGTCAACACCAAGGCCCAGGGGGAATGGAGTGAAGATCTCACTGC
TTGGACCCTTAGTGACATTCTTCCTCCTCAACCAGAAAACATCAAGATTTCCAACATTAC
ACACTCCTCGGCTGTGATTTCTTGGACAATATTGGATGGCTATTCTATTTCTTCTATTAC
TATCCGTTACAAGGTTCAAGGCAAGAATGAAGACCAGCACGTTGATGTGAAGATAAAGAA
TGCCACCATCATTCAGTATCAGCTCAAGGGCCTAGAGCCTGAAACAGCATACCAGGTGGA
CATTTTTGCAGAGAACAACATAGGGTCAAGCAACCCAGCCTTTTCTCATGAACTGGTGAC
CCTCCCAGAATCTCAAGCACCAGCGGACCTCGGAGGGGGAAGATGCTGCTTATAGCCAT
CCTTGGCTCTGCTGGAATGACCTGCCTGACTGTGCTGTTGGCCTTTCTGATCATATTGCA
ATTGAAGAGGGCAAATGTGCAAAGGAGAATGGCCCAAGCCTTCCAAAACGTGAGGGAAGA
ACCAGCTGTGCAGTTCAACTCAGGGACTCTGGCCCTAAACAGGAAGGTCAAAAACAACCC
AGATCCTACAATTTATCCAGTGCTTGACTGGAATGACATCAAATTTCAAGATGTGATTGG
GGAGGGCAATTTTGGCCAAGTTCTTAAGGCGCGCATCAAGAAGGATGGGTTACGGATGGA
TGCTGCCATCAAAAGAATGAAGAATATGCCTCCAAAGATGATCACAGGGACTTTGCAGG
AGAACTGGAAGTTCTTTGTAAACTTGGACACCATCCAAACATCATCAATCTCTTAGGAGC
```

FIGURE 81
(continued)

```
ATGTGAACATCGAGGCTACTTGTACCTGGCCATTGAGTACGCGCCCCATGGAAACCTTCT
GGACTTCCTTCGCAAGAGCCGTGTGCTGGAGACGGACCCAGCATTTGCCATTGCCAATAG
CACCGCGTCCACACTGTCCTCCCAGCAGCTCCTTCACTTCGCTGCCGACGTGGCCCGGGG
CATGGACTACTTGAGCCAAAAACAGTTTATCCACAGGGATCTGGCTGCCAGAAACATTTT
AGTTGGTGAAAACTATGTGGCAAAAATAGCAGATTTTGGATTGTCCCGAGGTCAAGAGGT
GTACGTGAAAAGACAATGGGAAGGCTCCCAGTGCGCTGGATGGCCATCGAGTCACTGAA
TTACAGTGTGTACACAACCAACAGTGATGTATGGTCCTATGGTGTGTTACTATGGGAGAT
TGTTAGCTTAGGAGGCACACCCTACTGCGGGATGACTTGTGCAGAACTCTACGAGAAGCT
GCCCCAGGGCTACAGACTGGAGAAGCCCCTGAACTGTGATGATGAGGTGTATGATCTAAT
GAGACAATGCTGGCGGGAGAAGCCTTATGAGAGGCCATCATTTGCCCAGATATTGGTGTC
CTTAAACAGAATGTTAGAGGAGCGAAAGACCTACGTAATACCACGCTTTATGAGAAGTT
TACTTATGCAGGAATTGACTGTTCTGCTGAAGAAGCGGCCTAGGACAGAACATCTGTATA
CCCTCTGTTTCCCTTTCACTGGCATGGGAGACCCTTGACAACTGCTGAGAAAACATGCCT
CTGCCAAAGGATGTGATATATAAGTGTACATATGTGCTGGAATTCTAACAAGTCATAGGT
TAATATTTAAGACACTGAAAAATCTAAGTGATATAAATCAGATTCTTCTCTCTCATTTTA
TCCCTCACCTGTAGCATGCCAGTCCCGTTTCATTTAGTCATGTGACCACTCTGTCTTGTG
TTTCCACAGCCTGCAAGTTCAGTCCAGGATGCTAACATCTAAAAATAGACTTAAATCTCA
TTGCTTACAAGCCTAAGAATCTTTAGAGAAGTATACATAAGTTTAGGATAAAATAATGGG
ATTTTCTTTTCTTTTCTCTGGTAATATTGACTTGTATATTTTAAGAAATAACAGAAAGCC
TGGGTGACATTTGGGAGACATGTGACATTTATATATTGAATTAATATCCCTACATGTATT
GCACATTGTAAAAAGTTTTAGTTTTGATGAGTTGTGAGTTTACCTTGTATACTGTAGGCA
CACTTTGCACTGATATATCATGAGTGAATAAATGTCTTGCCTACTCAAAAAAAAAAAA
```

FIGURE 82

```
MDSLASLVLCGVSLLLSGTVEGAMDLILINSLPLVSDAETSLTCIASGWRPHEPITIGRD
FEALMNQHQDPLEVTQDVTREWAKKVVWKREKASKINGAYFCEGRVRGEAIRIRTMKMRQ
QASFLPATLTMTVDKGDNVNISFKKVLIKEEDAVIYKNGSFIHSVPRHEVPDILEVHLPH
AQPQDAGVYSARYIGGNLFTSAFTRLIVRRCEAQKWGPECNHLCTACMNNGVCHEDTGEC
ICPPGFMGRTCEKACELHTFGRTCKERCSGQEGCKSYVFCLPDPYGCSATGWKGLQCNE
ACHPGFYGPDCKLRCSCNNGEMCDRFQGCLCSPGWQGLQCEREGIPRMTPKIVDLPDHIE
VNSGKFNPICKASGWPLPTNEEMTLVKPDGTVLHPKDFNHTDHFSVAIFTIHRILPPDSG
VWVCSVNTVAGMVEKPFNISVKVLPKPLNAPNVIDTGHNFAVINISSEPYFGDGPIKSKK
LLYKPVNHYEAWQHIQVTNEIVTLNYLEPRTEYELCVQLVRRGEGGEGHPGPVRRFTTAS
IGLPPPRGLNLLPKSQTTLNLTWQPIFPSSEDDFYVEVERRSVQKSDQQNIKVPGNLTSV
LLNNLHPREQYVVRARVNTKAQGEWSEDLTAWTLSDILPPQPENIKISNITHSSAVISWT
ILDGYSISSITIRYKVQGKNEDQHVDVKIKNATIIQYQLKGLEPETAYQVDIFAENNIGS
SNPAFSHELVTLPESQAPADLGGGKMLLIAILGSAGMTCLTVLLAFLIILQLKRANVQRR
MAQAFQNVREEPAVQFNSGTLALNRKVKNNPDPTIYPVLDWNDIKFQDVIGEGNFGQVLK
ARIKKDGLRMDAAIKRMKEYASKDDHRDFAGELEVLCKLGHHPNIINLLGACEHRGYLYL
AIEYAPHGNLLDFLRKSRVLETDPAFAIANSTASTLSSQQLLHFAADVARGMDYLSQKQF
IHRDLAARNILVGENYVAKIADFGLSRGQEVYVKKTMGRLPVRWMAIESLNYSVYTTNSD
VWSYGVLLWEIVSLGGTPYCGMTCAELYEKLPQGYRLEKPLNCDDEVYDLMRQCWREKPY
ERPSFAQILVSLNRMLEERKTYVNTTLYEKFTYAGIDCSAEEAA
```

Signal sequence:
1-38

Transmembrane domain:
750-770

N-glycosylation site:
140-143, 158-161, 399-402, 438-441, 464-467, 560-563, 596-599, 649-652, 691-694, 930-933, 1011-1014, 1104-1107 cAMP- and cGMP-dependent protein kinase phosphorylation site:
534-537

Tyrosine kinase phosphorylation site:
149-156, 808-816, 1094-1102

N-myristoylation site:
18-23, 98-103, 187-192, 196-201, 270-275, 286-291, 295-300, 420-425, 595-600, 984-989, 1036-1041, 1041-1046, 1115-1120

Prokaryotic membrane lipoprotein lipid attachment site:
882-892

FIGURE 82
(continued)

EGF-like domain cysteine pattern signature:
240-251, 287-298, 329-340

Tyrosine protein kinases specific active-site signature:
960-972

Protein kinase domain:
824-1092

Fibronectin type III domain:
444-529, 543-626, 639-724

EGF-like domain:
220-251, 268-298 laminin_EGF Laminin EGF-like (Domains III and V):
219-268

Immunoglobulin domain:
156-193

Zinc finger:
295-313

Receptor tyrosine kinase:
844-868, 869-898, 936-982, 986-1024, 1025-1052, 1052-1088

FIGURE 83

```
CGCGCCGGGCGCAGGGAGCTGAGTGGACGGCTCGAGACGGCGGCGCGTGCAGCAGCTCCA
GAAAGCAGCGAGTTGGCAGAGCAGGGCTGCATTTCCAGCAGGAGCTGCGAGCACAGTGCT
GGCTCACAACAAGATGCTCAAGGTGTCAGCCGTACTGTGTGTGTGCAGCCGCTTGGTG
CAGTCAGTCTCTCGCAGCTGCCGCGGCGGTGGCTGCAGCCGGGGGGCGGTCGGACGGCGG
TAATTTTCTGGATGATAAACAATGGCTCACCACAATCTCTCAGTATGACAAGGAAGTCGG
ACAGTGGAACAAATTCCGAGACGAAGTAGAGGATGATTATTTCCGCACTTGGAGTCCAGG
AAAACCCTTCGATCAGGCTTTAGATCCAGCTAAGGATCCATGCTTAAAGATGAAATGTAG
TCGCCATAAAGTATGCATTGCTCAAGATTCTCAGACTGCAGTCTGCATTAGTCACCGGAG
GCTTACACACAGGATGAAAGAAGCAGGAGTAGACCATAGGCAGTGGAGGGGTCCCATATT
ATCCACCTGCAAGCAGTGCCCAGTGGTCTATCCCAGCCCTGTTTGTGGTTCAGATGGTCA
TACCTACTCTTTTCAGTGCAAACTAGAATATCAGGCATGTGTCTTAGGAAAACAGATCTC
AGTCAAATGTGAAGGACATTGCCCATGTCCTTCAGATAAGCCCACCAGTACAAGCAGAAA
TGTTAAGAGAGCATGCAGTGACCTGGAGTTCAGGGAAGTGGCAAACAGATTGCGGGACTG
GTTCAAGGCCCTTCATGAAAGTGGAAGTCAAAACAAGAAGACAAAAACATTGCTGAGGCC
TGAGAGAAGCAGATTCGATACCAGCATCTTGCCAATTTGCAAGGACTCACTTGGCTGGAT
GTTTAACAGACTTGATACAAACTATGACCTGCTATTGGACCAGTCAGAGCTCAGAAGCAT
TTACCTTGATAAGAATGAACAGTGTACCAAGGCATTCTTCAATTCTTGTGACACATACAA
GGACAGTTTAATATCTAATAATGAGTGGTGCTACTGCTTCCAGAGACAGCAAGACCCACC
TTGCCAGACTGAGCTCAGCAATATTCAGAAGCGGCAAGGGGTAAAGAAGCTCCTAGGACA
GTATATCCCCCTGTGTGATGAAGATGGTTACTACAAGCCAACACAATGTCATGGCAGTGT
TGGACAGTGCTGGTGTGTTGACAGATATGGAAATGAAGTCATGGATCCAGAATAAATGG
TGTTGCAGATTGTGCTATAGATTTTGAGATCTCCGGAGATTTTGCTAGTGGCGATTTTCA
TGAATGGACTGATGATGAGGATGATGAAGACGATATTATGAATGATGAAGATGAAATTGA
AGATGATGATGAAGATGAAGGGGATGATGATGATGGTGGTGATGACCATGATGTATACAT
TTGATTGATGACAGTTGAAATCAATAAATTCTACATTTCTAATATTTACAAAAATGATAG
CCTATTTAAAATTATCTTCTTCCCCAATAACAAAATGATTCTAAACCTCACATATATTTT
GTATAATTATTTGAAAAATTGCAGCTAAAGTTATAGAACTTTATGTTTAAATAAGAATCA
TTTGCTTTGAGTTTTTATATTCCTTACACAAAAGAAAATACATATGCAGTCTAGTCAGA
CAAAATAAAGTTTTGAAGTGCTACTATAATAAATTTTTCACGAGAACAAACTTTGTAAAT
CTTCCATAAGCAAAATGACAGCTAGTGCTTGGATCGTACATGTTAATTTTTTGAAAGAT
AATTCTAAGTGAAATTTAAAATAAATAAATTTTTAATGACCTGGGTCTTAAGGATTTAGG
AAAAATATGCATGCTTTAATTGCATTTCCAAAGTAGCATCTTGCTAGACCTAGATGAGTC
AGGATAACAGAGAGATACCACATGACTCCAAAAAAAAAAAAAA
```

FIGURE 84

MLKVSAVLCVCAAAWCSQSLAAAAAVAAAGGRSDGGNFLDDKQWLTTISQYDKEVGQWNK
FRDEVEDDYFRTWSPGKPFDQALDPAKDPCLKMKCSRHKVCIAQDSQTAVCISHRRLTHR
MKEAGVDHRQWRGPILSTCKQCPVVYPSPVCGSDGHTYSFQCKLEYQACVLGKQISVKCE
GHCPCPSDKPTSTSRNVKRACSDLEFREVANRLRDWFKALHESGSQNKKTKTLLRPERSR
FDTSILPICKDSLGWMFNRLDTNYDLLLDQSELRSIYLDKNEQCTKAFFNSCDTYKDSLI
SNNEWCYCFQRQQDPPCQTELSNIQKRQGVKKLLGQYIPLCDEDGYYKPTQCHGSVGQCW
CVDRYGNEVMGSRINGVADCAIDFEISGDFASGDFHEWTDDEDDEDDIMNDEDEIEDDDE
DEGDDDDGGDDHDVYI

Important features:
Signal peptide:
amino acids 1-16

Leucine zipper pattern:
amino acids 246-267

N-myristoylation sites:
amino acids 357-362, 371-376 and 376-381

Thyroglobulin type-1 repeat proteins:
amino acids 353-365 and 339-352

FIGURE 85

CCCACGCGTCCGGCACTGCAGTCTCCAGCCTGAGCCATGGGCCGCCGAGCCCTCCTGCTC
CTGCTTCTGTCTTTTCTGGCGCCCTGGGCCACCATAGCCCTCCGGCCGGCCTTAAGGGCC
CTCGGCAGCCTACACTTGCCAACCAACCCCACATCCCTCCCGGCTGTAGCCAAGAACTAT
TCGGTTCTCTACTTCCAACAGAAGGTTGATCATTTTGGATTTAATACTGTGAAAACTTTT
AATCAGCGGTACCTAGTAGCTGATAAATACTGGAAGAAAAATGGTGGATCAATACTTTC
TACACTGGTAATGAAGGGGACATTATCTGGTTTTGTAATAACACGGGGTTCATGTGGGAT
GTGGCTGAGGAACTGAAAGCTATGTTGGTGTTTGCTGAACATCGATACTATGGAGAGTCT
CTCCCCTTTGGTGACAACTCATTCAAGGATTCCAGACACTTGAATTTCCTGACATCAGAA
CAAGCTCTGGCTGATTTTGCAGAGTTAATCAAACACTTGAAAAGAACAATCCCAGGAGCT
GAAAATCAACCTGTCATTGCCATAGGAGGCTCCTATGGTGGCATGCTTGCCGCCTGGTTT
AGGATGAAATATCCTCATATGGTAGTTGGAGCTCTTGCAGCTTCTGCCCCTATCTGGCAG
TTTGAGGATTTAGTACCTTGTGGTGTATTTATGAAGATCGTAACTACAGATTTTAGGAAA
AGCGGTCCACATTGTTCAGAGAGCATCCACAGGTCCTGGGATGCCATTAATCGACTCTCA
AATACTGGCAGTGGTTTGCAGTGGCTTACTGGAGCCCTTCACTTATGCAGCCCATTAACT
TCTCAGGACATCCAACATTTGAAAGACTGGATCTCTGAAACCTGGGTGAATCTGGCAATG
GTGGACTATCCTTATGCCTCTAACTTTTTACAGCCTTTGCCTGCTTGGCCTATCAAGGTA
GTGTGCCAGTATTTGAAAAATCCCAATGTATCTGATTCACTGCTGCTGCAGAATATTTTC
CAAGCTCTGAATGTATATTACAATTATTCGGGCCAGGTGAAATGCCTGAATATTTCAGAG
ACAGCAACTAGCAGTCTGGGAACACTGGGTTGGAGCTATCAGGCCTGCACAGAAGTAGTC
ATGCCCTTTTGTACTAATGGTGTCGATGACATGTTTGAACCTCACTCATGGAACTTAAAG
GAACTTTCTGATGACTGTTTTCAACAGTGGGGTGTGAGACCAAGGCCCTCCTGGATCACT
ACTATGTATGGAGGCAAAAACATTAGTTCACACACAAACATTGTTTTCAGCAATGGTGAA
CTAGACCCCTGGTCAGGAGGTGGAGTAACTAAGGATATCACAGACACTCTGGTTGCAGTC
ACCATCTCAGAGGGGGCCCACCACTTAGATCTCCGCACCAAGAATGCCTTGGATCCTATG
TCTGTGCTGTTAGCCCGCTCCTTGGAAGTTAGACATATGAAGAATTGGATCAGAGATTTC
TATGACAGTGCGGGAAAGCAGCACTGAGAAACTTTTGATTGTTTTCAATTTCTTCTTTTA
TGTTCACACCACCACATTCCCATTCACTTTGATTTTCTACATGTAATTACCTTCTTTTGT
TTATCATTAGATTTGATGGGGCCAAAGTTGAGATAGAATAGAGGGTGATGACGGTAAGAG
CAAGTGTCCCATGAATGTGATTTCCTGGGTTCTCACTGTCCTTTGCACCACGTCTAGGAA
GAATCTTCTTGATAGCTCTCCCACACCATCAGTGGCCCTCATAACTGGAGTAGAGTTCCT
GGTTGCTTTTCATAAGAGGGAGAGTTACTTTC

FIGURE 86

MGRRALLLLLLSFLAPWATIALRPALRALGSLHLPTNPTSLPAVAKNYSVLYFQQKVDHF
GFNTVKTFNQRYLVADKYWKKNGGSILFYTGNEGDIIWFCNNTGFMWDVAEELKAMLVFA
EHRYYGESLPFGDNSFKDSRHLNFLTSEQALADFAELIKHLKRTIPGAENQPVIAIGGSY
GGMLAAWFRMKYPHMVVGALAASAPIWQFEDLVPCGVFMKIVTTDFRKSGPHCSESIHRS
WDAINRLSNTGSGLQWLTGALHLCSPLTSQDIQHLKDWISETWVNLAMVDYPYASNFLQP
LPAWPIKVVCQYLKNPNVSDSLLLQNIFQALNVYYNYSGQVKCLNISETATSSLGTLGWS
YQACTEVVMPFCTNGVDDMFEPHSWNLKELSDDCFQQWGVRPRPSWITTMYGGKNISSHT
NIVFSNGELDPWSGGGVTKDITDTLVAVTISEGAHHLDLRTKNALDPMSVLLARSLEVRH
MKNWIRDFYDSAGKQH

Signal sequence:
1-18

Transmembrane domain:
None

N-glycosylation site:
47-50, 101-104, 317-320, 336-339, 345-348, 415-418

Glycosaminoglycan attachment site:
433-436

N-myristoylation site:
178-183, 181-186, 182-187, 198-203, 339-344, 434-439

Amidation site:
1-4 alpha/beta hydrolase fold:
115-372

FIGURE 87

```
GGCGGCGTCCGTGAGGGGCTCCTTTGGGCAGGGGTAGTGTTTGGTGTCCCTGTCTTGCGT
GATATTGACAAACTGAAGCTTTCCTGCACCACTGGACTTAAGGAAGAGTGTACTCGTAGG
CGGACAGCTTTAGTGGCCGGCCGGCCGCTCTCATCCCCCGTAAGGAGCAGAGTCCTTTGT
ACTGACCAAGATGAGCAACATCTACATCCAGGAGCCTCCCACGAATGGGAAGGTTTTATT
GAAAACTACAGCTGGAGATATTGACATAGAGTTGTGGTCCAAAGAAGCTCCTAAAGCTTG
CAGAAATTTTATCCAACTTTGTTTGGAAGCTTATTATGACAATACCATTTTTCATAGAGT
TGTGCCTGGTTTCATAGTCCAAGGCGGAGATCCTACTGGCACAGGGAGTGGTGGAGAGTC
TATCTATGGAGCGCCATTCAAAGATGAATTTCATTCACGGTTGCGTTTTAATCGGAGAGG
ACTGGTTGCCATGGCAAATGCTGGTTCTCATGATAATGGCAGCCAGTTTTCTTCACACT
GGGTCGAGCAGATGAACTTAACAATAAGCATACCATCTTTGGAAAGGTTACAGGGGATAC
AGTATATAACATGTTGCGACTGTCAGAAGTAGACATTGATGATGACGAAGACCACATAA
TCCACACAAAATAAAAAGCTGTGAGGTTTTGTTTAATCCTTTTGATGACATCATTCCAAG
GGAAATTAAAAGGCTGAAAAAGAGAAACCAGAGGAGGAAGTAAAGAAATTGAAACCCAA
AGGCACAAAAAATTTTAGTTTACTTTCATTTGGAGAGGAAGCTGAGGAAGAAGAGGAGGA
AGTAAATCGAGTTAGTCAGAGCATGAAGGGCAAAAGCAAAGTAGTCATGACTTGCTTAA
GGATGATCCACATCTCAGTTCTGTTCCAGTTGTAGAAAGTGAAAAAGGTGATGCACCAGA
TTTAGTTGATGATGGAGAAGATGAAAGTGCAGAGCATGATGAATATATTGATGGTGATGA
AAAGAACCTGATGAGAGAAAGAATTGCCAAAAAATTAAAAAAGGACACAAGTGCGAATGT
TAAATCAGCTGGAGAAGGAGAAGTGGAGAAGAAATCAGTCAGCCGCAGTGAAGAGCTCAG
AAAAGAAGCAAGACAATTAAAACGGGAACTCTTAGCAGCAAAACAAAAAAAGTAGAAAA
TGCAGCAAAACAAGCAGAAAAAGAAGTGAAGAGGAAGAAGCCCCTCCAGATGGTGCTGT
TGCCGAATACAGAAGAGAAAAGCAAAGTATGAAGCTTTGAGGAAGCAACAGTCAAAGAA
GGGAACTTCCCGGGAAGATCAGACCCTTGCACTGCTGAACCAGTTTAAATCTAAACTCAC
TCAAGCAATTGCTGAAACACCTGAAAATGACATTCCTGAAACAGAAGTAGAAGATGATGA
AGGATGGATGTCACATGTACTTCAGTTTGAGGATAAAAGCAGAAAAGTGAAAGATGCAAG
CATGCAAGACTCAGATACATTTGAAATCTATGATCCTCGGAATCCAGTGAATAAAAGAAG
GAGGGAAGAAAGCAAAAAGCTGATGAGAGAGAAAAAGAAAGAAGATAAAATGAGAATAA
TGATAACCAGAACTTGCTGGAAATGTGCCTACAATGGCCTTGTAACAGCCATTGTTCCCA
ACAGCATCACTTAGGGGTGTGAAAAGAAGTATTTTTGAACCTGTTGTCTGGTTTTGAAAA
ACAATTATCTTGTTTTGCAAATTGTGGAATGATGTAAGCAAATGCTTTTGGTTACTGGTA
CATGTGTTTTTTCCTAGCTGACCTTTTATATTGCTAAATCTGAATAAAATAACTTTCCT
TCCACAAAAAAAAAAAAAAAAAAAAAAAAAAAA
```

FIGURE 88

MSNIYIQEPPTNGKVLLKTTAGDIDIELWSKEAPKACRNFIQLCLEAYYDNTIFHRVVPG
FIVQGGDPTGTGSGGESIYGAPFKDEFHSRLRFNRRGLVAMANAGSHDNGSQFFFTLGRA
DELNNKHTIFGKVTGDTVYNMLRLSEVDIDDDERPHNPHKIKSCEVLFNPFDDIIPREIK
RLKKEKPEEEVKKLKPKGTKNFSLLSFGEEAEEEEEEVNRVSQSMKGKSKSSHDLLKDDP
HLSSVPVVESEKGDAPDLVDDGEDESAEHDEYIDGDEKNLMRERIAKKLKKDTSANVKSA
GEGEVEKKSVSRSEELRKEARQLKRELLAAKQKKVENAAKQAEKRSEEEEAPPDGAVAEY
RREKQKYEALRKQQSKKGTSREDQTLALLNQFKSKLTQAIAETPENDIPETEVEDDEGWM
SHVLQFEDKSRKVKDASMQDSDTFEIYDPRNPVNKRRREESKKLMREKKERR

Important features:
Signal peptide:
amino acids 1-21

N-glycosylation sites:
amino acids 109-112 and 201-204

Cyclophilin-type peptidyl-prolyl cis-trans isomerase
signature:
amino acids 49-66

Homologous region to Cyclophilin-type peptidyl-prolyl cis-trans isomerase:
amino acids 96-140, 49-89 and 22-51

FIGURE 89

CCCGGCTCCGCTCCCTCTGCCCCCTCGGGGTCGCGCGCCCACG<u>ATG</u>CTGCAGGGCCCTGG
CTCGCTGCTGCTGCTCTTCCTCGCCTCGCACTGCTGCCTGGGCTCGGCGCGCGGGCTCTT
CCTCTTTGGCCAGCCCGACTTCTCCTACAAGCGCAGCAATTGCAAGCCCATCCCGGTCAA
CCTGCAGCTGTGCCACGGCATCGAATACCAGAACATGCGGCTGCCCAACCTGCTGGGCCA
CGAGACCATGAAGGAGGTGCTGGAGCAGGCCGGCGCTTGGATCCCGCTGGTCATGAAGCA
GTGCCACCCGGACACCAAGAAGTTCCTGTGCTCGCTCTTCGCCCCGTCTGCCTCGATGA
CCTAGACGAGACCATCCAGCCATGCCACTCGCTCTGCGTGCAGGTGAAGGACCGCTGCGC
CCCGGTCATGTCCGCCTTCGGCTTCCCCTGGCCCGACATGCTTGAGTGCGACCGTTTCCC
CCAGGACAACGACCTTTGCATCCCCCTCGCTAGCAGCGACCACCTCCTGCCAGCCACCGA
GGAAGCTCCAAAGGTATGTGAAGCCTGCAAAATAAAATGATGATGACAACGACATAAT
GGAAACGCTTTGTAAAAATGATTTTGCACTGAAAATAAAAGTGAAGGAGATAACCTACAT
CAACCGAGATACCAAAATCATCCTGGAGACCAAGAGCAAGACCATTTACAAGCTGAACGG
TGTGTCCGAAAGGGACCTGAAGAAATCGGTGCTGTGGCTCAAAGACAGCTTGCAGTGCAC
CTGTGAGGAGATGAACGACATCAACGCGCCCTATCTGGTCATGGGACAGAAACAGGGTGG
GGAGCTGGTGATCACCTCGGTGAAGCGGTGGCAGAAGGGGCAGAGAGAGTTCAAGCGCAT
CTCCCGCAGCATCCGCAAGCTGCAGTGC<u>TAG</u>TCCCGGCATCCTGATGGCTCCGACAGGCC
TGCTCCAGAGCACGGCTGACCATTTCTGCTCCGGGATCTCAGCTCCCGTTCCCAAGCAC
ACTCCTAGCTGCTCCAGTCTCAGCCTGGGCAGCTTCCCCCTGCCTTTTGCACGTTTGCAT
CCCCAGCATTTCCTGAGTTATAAGGCCACAGGAGTGGATAGCTGTTTTCACCTAAAGGAA
AAGCCCACCCGAATCTTGTAGAAATATTCAAACTAATAAAATCATGAATATTTTAA

FIGURE 90

MLQGPGSLLLLFLASHCCLGSARGLFLFGQPDFSYKRSNCKPIPVNLQLCHGIEYQNMRL
PNLLGHETMKEVLEQAGAWIPLVMKQCHPDTKKFLCSLFAPVCLDDLDETIQPCHSLCVQ
VKDRCAPVMSAFGFPWPDMLECDRFPQDNDLCIPLASSDHLLPATEEAPKVCEACKNKND
DDNDIMETLCKNDFALKIKVKEITYINRDTKIILETKSKTIYKLNGVSERDLKKSVLWLK
DSLQCTCEEMNDINAPYLVMGQKQGGELVITSVKRWQKGQREFKRISRSIRKLQC

Important features:
Signal peptide:
amino acids 1-20

Cysteine rich domain, homolgous to frizzled N terminus:
amino acids 6-153

FIGURE 91

```
GGAAGGGGAGGAGCAGGCCACACAGGCACAGGCCGGTGAGGGACCTGCCCAGACCTGGAG
GGTCTCGCTCTGTCACACAGGCTGGAGTGCAGTGGTGTGATCTTGGCTCATCGTAACCTC
CACCTCCCGGGTTCAAGTGATTCTCATGCCTCAGCCTCCCGAGTAGCTGGGATTACAGGT
GGTGACTTCCAAGAGTGACTCCGTCGGAGGAAAATGACTCCCCAGTCGCTGCTGCAGACG
ACACTGTTCCTGCTGAGTCTGCTCTTCCTGGTCCAAGGTGCCCACGGCAGGGCCACAGG
GAAGACTTTCGCTTCTGCAGCCAGCGGAACCAGACACACAGGAGCAGCCTCCACTACAAA
CCCACACCAGACCTGCGCATCTCCATCGAGAACTCCGAAGAGGCCCTCACAGTCCATGCC
CCTTTCCCTGCAGCCCACCCTGCTTCCCGATCCTTCCCTGACCCCAGGGGCCTCTACCAC
TTCTGCCTCTACTGGAACCGACATGCTGGGAGATTACATCTTCTCTATGGCAAGCGTGAC
TTCTTGCTGAGTGACAAAGCCTCTAGCCTCCTCTGCTTCCAGCACCAGGAGGAGAGCCTG
GCTCAGGGCCCCCCGCTGTTAGCCACTTCTGTCACCTCCTGGTGGAGCCCTCAGAACATC
AGCCTGCCCAGTGCCGCCAGCTTCACCTTCTCCTTCCACAGTCCTCCCCACACGGCCGCT
CACAATGCCTCGGTGGACATGTGCGAGCTCAAAAGGGACCTCCAGCTGCTCAGCCAGTTC
CTGAAGCATCCCCAGAAGGCCTCAAGGAGGCCCTCGGCTGCCCCGCCAGCCAGCAGTTG
CAGAGCCTGGAGTCGAAACTGACCTCTGTGAGATTCATGGGGGACATGGTGTCCTTCGAG
GAGGACCGGATCAACGCCACGGTGTGGAAGCTCCAGCCCACAGCCGGCCTCCAGGACCTG
CACATCCACTCCCGGCAGGAGGAGGAGCAGAGCGAGATCATGGAGTACTCGGTGCTGCTG
CCTCGAACACTCTTCCAGAGGACGAAAGGCCGGAGCGGGGAGGCTGAGAAGAGACTCCTC
CTGGTGGACTTCAGCAGCCAAGCCCTGTTCCAGGACAAGAATTCCAGCCAAGTCCTGGGT
GAGAAGGTCTTGGGGATTGTGGTACAGAACACCAAAGTAGCCAACCTCACGGAGCCCGTG
GTGCTCACTTTCCAGCACCAGCTACAGCCGAAGAATGTGACTCTGCAATGTGTGTTCTGG
GTTGAAGACCCCACATTGAGCAGCCCGGGGCATTGGAGCAGTGCTGGGTGTGAGACCGTC
AGGAGAGAAACCCAAACATCCTGCTTCTGCAACCACTTGACCTACTTTGCAGTGCTGATG
GTCTCCTCGGTGGAGGTGGACGCCGTGCACAAGCACTACCTGAGCCTCCTCTCCTACGTG
GGCTGTGTCGTCTCTGCCCTGGCCTGCCTTGTCACCATTGCCGCCTACCTCTGCTCCAGG
GTGCCCCTGCCGTGCAGGAGGAAACCTCGGGACTACACCATCAAGGTGCACATGAACCTG
CTGCTGGCCGTCTTCCTGCTGGACACGAGCTTCCTGCTCAGCGAGCCGGTGGCCCTGACA
GGCTCTGAGGCTGGCTGCCGAGCCAGTGCCATCTTCCTGCACTTCTCCCTGCTCACCTGC
CTTTCCTGGATGGGCCTCGAGGGGTACAACCTCTACCGACTCGTGGTGGAGGTCTTTGGC
ACCTATGTCCCTGGCTACCTACTCAAGCTGAGCGCCATGGGCTGGGGCTTCCCCATCTTT
CTGGTGACGCTGGTGGCCCTGGTGGATGTGGACAACTATGGCCCCATCATCTTGGCTGTG
CATAGGACTCCAGAGGGCGTCATCTACCCTTCCATGTGCTGGATCCGGGACTCCCTGGTC
AGCTACATCACCAACCTGGGCCTCTTCAGCCTGGTGTTTCTGTTCAACATGGCCATGCTA
GCCACCATGGTGGTGCAGATCCTGCGGCTGCGCCCCACACCCAAAAGTGGTCACATGTG
CTGACACTGCTGGGCCTCAGCCTGGTCCTTGGCCTGCCTGGGCCTTGATCTTCTTCTCC
TTTGCTTCTGGCACCTTCCAGCTTGTCGTCCTCTACCTTTTCAGCATCATCACCTCCTTC
CAAGGCTTCCTCATCTTCATCTGGTACTGGTCCATGCGGCTGCAGGCCCGGGGTGGCCCC
TCCCCTCTGAAGAGCAACTCAGACAGCGCCAGGCTCCCCATCAGCTCGGGCAGCACCTCG
TCCAGCCGCATCTAGGCCTCCAGCCCACCTGCCCATGTGATGAAGCAGAGATGCGGCCTC
GTCGCACACTGCCTGTGGCCCCGAGCCAGGCCCAGCCCCAGGCCAGTCAGCCGCAGACT
TTGGAAAGCCCAACGACCATGGAGAGATGGGCCGTTGCCATGGTGGACGGACTCCCGGGC
TGGGCTTTTGAATTGGCCTTGGGGACTACTCGGCTCTCACTCAGCTCCCACGGGACTCAG
AAGTGCGCCGCCATGCTGCCTAGGGTACTGTCCCCACATCTGTCCCAACCCAGCTGGAGG
CCTGGTCTCTCCTTACAACCCCTGGGCCCAGCCCTCATTGCTGGGGGCCAGGCCTTGGAT
CTTGAGGGTCTGGCACATCCTTAATCCTGTGCCCCTGCCTGGGACAGAAATGTGGCTCCA
GTTGCTCTGTCTCTCGTGGTCACCCTGAGGGCACTCTGCATCCTCTGTCATTTTAACCTC
AGGTGGCACCCAGGGCGAATGGGGCCCAGGGCAGACCTTCAGGGCCAGAGCCCTGGCGGA
```

FIGURE 91
(continued)

```
GGAGAGGCCCTTTGCCAGGAGCACAGCAGCAGCTCGCCTACCTCTGAGCCCAGGCCCCCT
CCCTCCCTCAGCCCCCCAGTCCTCCCTCCATCTTCCCTGGGGTTCTCCTCCTCTCCCAGG
GCCTCCTTGCTCCTTCGTTCACAGCTGGGGGTCCCCGATTCCAATGCTGTTTTTTGGGGA
GTGGTTTCCAGGAGCTGCCTGGTGTCTGCTGTAAATGTTTGTCTACTGCACAAGCCTCGG
CCTGCCCCTGAGCCAGGCTCGGTACCGATGCGTGGGCTGGGCTAGGTCCCTCTGTCCATC
TGGGCCTTTGTATGAGCTGCATTGCCCTTGCTCACCCTGACCAAGCACACGCCTCAGAGG
GGCCCTCAGCCTCTCCTGAAGCCCTCTTGTGGCAAGAACTGTGGACCATGCCAGTCCCGT
CTGGTTTCCATCCCACCACTCCAAGGACTGAGACTGACCTCCTCTGGTGACACTGGCCTA
GAGCCTGACACTCTCCTAAGAGGTTCTCTCCAAGCCCCCAAATAGCTCCAGGCGCCCTCG
GCCGCCCATCATGGTTAATTCTGTCCAACAAACACACACGGGTAGATTGCTGGCCTGTTG
TAGGTGGTAGGGACACAGATGACCGACCTGGTCACTCCTCCTGCCAACATTCAGTCTGGT
ATGTGAGGCGTGCGTGAAGCAAGAACTCCTGGAGCTACAGGGACAGGGAGCCATCATTCC
TGCCTGGGAATCCTGGAAGACTTCCTGCAGGAGTCAGCGTTCAATCTTGACCTTGAAGAT
GGGAAGGATGTTCTTTTTACGTACCAATTCTTTTGTCTTTTGATATTAAAAAGAAGTACA
TGTTCATTGTAGAGAATTTGGAAACTGTAGAAGAGAATCAAGAAGAAAAATAAAAATCAG
CTGTTGTAATCGCCTAGCAAAAAAAAAAAAAAAAAAAAAAAAAAAAAAAAAAAAAAAAAA
AAAAAAAAAAAAAAAAAAAAAAAAAAAAAAAAAAAAAA
```

FIGURE 92

```
MTPQSLLQTTLFLLSLLFLVQGAHGRGHREDFRFCSQRNQTHRSSLHYKPTPDLRISIEN
SEEALTVHAPFPAAHPASRSFPDPRGLYHFCLYWNRHAGRLHLLYGKRDFLLSDKASSLL
CFQHQEESLAQGPPLLATSVTSWWSPQNISLPSAASFTFSFHSPPHTAAHNASVDMCELK
RDLQLLSQFLKHPQKASRRPSAAPASQQLQSLESKLTSVRFMGDMVSFEEDRINATVWKL
QPTAGLQDLHIHSRQEEEQSEIMEYSVLLPRTLFQRTKGRSGEAEKRLLLVDFSSQALFQ
DKNSSQVLGEKVLGIVVQNTKVANLTEPVVLTFQHQLQPKNVTLQCVFWVEDPTLSSPGH
WSSAGCETVRRETQTSCFCNHLTYFAVLMVSSVEVDAVHKHYLSLLSYVGCVVSALACLV
TIAAYLCSRVPLPCRRKPRDYTIKVHMNLLLAVFLLDTSFLLSEPVALTGSEAGCRASAI
FLHFSLLTCLSWMGLEGYNLYRLVVEVFGTYVPGYLLKLSAMGWGFPIFLVTLVALVDVD
NYGPIILAVHRTPEGVIYPSMCWIRDSLVSYITNLGLFSLVFLFNMAMLATMVVQILRLR
PHTQKWSHVLTLLGLSLVLGLPWALIFFSFASGTFQLVVLYLFSIITSFQGFLIFIWYWS
MRLQARGGPSPLKSNSDSARLPISSGSTSSSRI
```

Important features:
Signal peptide:
amino acids 1-25

Putative transmembrane domains:
amino acids 382-398, 402-420, 445-468, 473-491, 519-537, 568-590 and 634-657

Microbodies C-terminal targeting signal:
amino acids 691-693 cAMP- and cGMP-dependent protein kinase phosphorylation sites:
amino acids 198-201 and 370-373

N-glycosylation sites:
amino acids 39-42, 148-151, 171-174, 234-237, 303-306, 324-327 and 341-344

G-protein coupled receptors family 2 proteins:
amino acids 475-504

FIGURE 93

CCCACGCGTCCGAAGGCAGACAAAGGTTCATTTGTAAAGAAGCTCCTTCCAGCACCTCCT
CTCTTCTCCTTTTGCCCAAACTCACCCAGTGAGTGTGAGCATTTAAGAAGCATCCTCTGC
CAAGACCAAAAGGAAAGAAGAAAAAGGGCCAAAAGCCAAAATGAAACTGATGGTACTTGT
TTTCACCATTGGGCTAACTTTGCTGCTAGGAGTTCAAGCCATGCCTGCAAATCGCCTCTC
TTGCTACAGAAAGATACTAAAAGATCACAACTGTCACAACCTTCCGGAAGGAGTAGCTGA
CCTGACACAGATTGATGTCAATGTCCAGGATCATTTCTGGGATGGGAAGGGATGTGAGAT
GATCTGTTACTGCAACTTCAGCGAATTGCTCTGCTGCCCAAAAGACGTTTTCTTTGGACC
AAAGATCTCTTTCGTGATTCCTTGCAACAATCAATGAGAATCTTCATGTATTCTGGAGAA
CACCATTCCTGATTTCCCACAAACTGCACTACATCAGTATAACTGCATTTCTAGTTTCTA
TATAGTGCAATAGAGCATAGATTCTATAAATTCTTACTTGTCTAAGACAAGTAAATCTGT
GTTAAACAAGTAGTAATAAAAGTTAATTCAATCTAAAAAAAAAAAAA

FIGURE 94

MKLMVLVFTIGLTLLLGVQAMPANRLSCYRKILKDHNCHNLPEGVADLTQIDVNVQDHFW
DGKGCEMICYCNFSELLCCPKDVFFGPKISFVIPCNNQ

Important features:
Signal peptide:
amino acids 1-20

N-glycosylation site:
amino acids 72-76

Tyrosine kinase phosphorylation site:
amino acids 63-71

FIGURE 95

GAATTCCGGGCCCCAGGATGCCAACTTTGAATAGGATGAAGACTACAACTTGTTCCCTTC
TCATCTGCATCTCCCTGCTCCAGCTGATGGTCCCAGTGAATACTGATGAGACCATAGAGA
TTATCGTGGAGAATAAGGTCAAGGAACTTCTTGCCAATCCAGCTAACTATCCCTCCACTG
TAACGAAGACTCTCTCTTGCACTAGTGTCAAGACTATGAACAGATGGGCCTCCTGCCCTG
CTGGGATGACTGCTACTGGGTGTGCTTGTGGCTTTGCCTGTGGATCTTGGGAGATCCAGA
GTGGAGATACTTGCAACTGCCTGTGCTTACTCGTTGACTGGACCACTGCCCGCTGCTGCC
AACTGTCCTAAGAATGAAGAGGTGGAGAACCCAGCTTTGATATGATGAATCTAACAAAAA
CTGCAGTCTCAATTTGGAAATCTGACTCATGTGCCTTTAAATGTGTTCATATTGCCCATT
TACCCTGCTTCTTGAAATGCTTCTTGAAAAATAAGACAAATTTGCATGTG

FIGURE 96

MKTTTCSLLICISLLQLMVPVNTDETIEIIVENKVKELLANPANYPSTVTKTLSCTSVK
TMNRWASCPAGMTATGCACGFACGSWEIQSGDTCNCLCLLVDWTTARCCQLS

FIGURE 97

```
GAGGCAGAAAGGCAGAAAGGAGAAAATTCAGGATAACTCTCCTGAGGGGTGAGCCAAGCC
CTGCCATGTAGTGCACGCAGGACATCAACAAACACAGATAACAGGAAATGATCCATTCCC
TGTGGTCACTTATTCTAAAGGCCCCAACCTTCAAAGTTCAAGTAGTGATATGGATGACTC
CACAGAAAGGGAGCAGTCACGCCTTACTTCTTGCCTTAAGAAAAGAGAAGAAATGAAACT
GAAGGAGTGTGTTTCCATCCTCCCACGGAAGGAAAGCCCCTCTGTCCGATCCTCCAAAGA
CGGAAAGCTGCTGGCTGCAACCTTGCTGCTGGCACTGCTGTCTTGCTGCCTCACGGTGGT
GTCTTTCTACCAGGTGGCCGCCCTGCAAGGGGACCTGGCCAGCCTCCGGGCAGAGCTGCA
GGGCCACCACGCGGAGAAGCTGCCAGCAGGAGCAGGAGCCCCCAAGGCCGGCCTGGAGGA
AGCTCCAGCTGTCACCGCGGGACTGAAAATCTTTGAACCACCAGCTCCAGGAGAAGGCAA
CTCCAGTCAGAACAGCAGAAATAAGCGTGCCGTTCAGGGTCCAGAAGAAACAGTCACTCA
AGACTGCTTGCAACTGATTGCAGACAGTGAAACACCAACTATACAAAAGGATCTTACAC
ATTTGTTCCATGGCTTCTCAGCTTTAAAAGGGGAAGTGCCCTAGAAGAAAAAGAGAATAA
AATATTGGTCAAAGAAACTGGTTACTTTTTTATATATGGTCAGGTTTTATATACTGATAA
GACCTACGCCATGGGACATCTAATTCAGAGGAAGAAGGTCCATGTCTTTGGGGATGAATT
GAGTCTGGTGACTTTGTTTCGATGTATTCAAAATATGCCTGAAACACTACCCAATAATTC
CTGCTATTCAGCTGGCATTGCAAAACTGGAAGAAGGAGATGAACTCCAACTTGCAATACC
AAGAGAAATGCACAAATATCACTGGATGGAGATGTCACATTTTTTGGTGCATTGAAACT
GCTGTGACCTACTTACACCATGTCTGTAGCTATTTTCCTCCCTTTCTCTGTACCTCTAAG
AAGAAAGAATCTAACTGAAAATACCAAAAAAAAAAAAAAAA
```

FIGURE 98

MDDSTEREQSRLTSCLKKREEMKLKECVSILPRKESPSVRSSKDGKLLAATLLLALLSCC
LTVVSFYQVAALQGDLASLRAELQGHHAEKLPAGAGAPKAGLEEAPAVTAGLKIFEPPAP
GEGNSSQNSRNKRAVQGPEETVTQDCLQLIADSETPTIQKGSYTFVPWLLSFKRGSALEE
KENKILVKETGYFFIYGQVLYTDKTYAMGHLIQRKKVHVFGDELSLVTLFRCIQNMPETL
PNNSCYSAGIAKLEEGDELQLAIPRENAQISLDGDVTFFGALKLL

Transmembrane domain:
amino acids 47-72

N-glycosylation site:
amino acids 124-127, 242-245 cAMP- and cGMP-dependent protein kinase phosphorylation site:
amino acids 33-36, 173-176

N-myristoylation site:
amino acids 96-101

TNF family proteins:
amino acids 172-206

FIGURE 99

```
GCGAGGTGGCGATCGCTGAGAGGCAGGAGGGCCGAGGCGGGCCTGGGAGGCGGCCCGGAG
GTGGGGCGCCGCTGGGGCCGGCCCGCACGGGCTTCATCTGAGGGCGCACGGCCCGCGACC
GAGCGTGCGGACTGGCCTCCCAAGCGTGGGGCGACAAGCTGCCGGAGCTGCAATGGGCCG
CGGCTGGGGATTCTTGTTTGGCCTCCTGGGCGCCGTGTGGCTGCTCAGCTCGGGCCACGG
AGAGGAGCAGCCCCGGAGACAGCGGCACAGAGGTGCTTCTGCCAGGTTAGTGGTTACTT
GGATGATTGTACCTGTGATGTTGAAACCATTGATAGATTTAATAACTACAGGCTTTTCCC
AAGACTACAAAAACTTCTTGAAAGTGACTACTTTAGGTATTACAAGGTAAACCTGAAGAG
GCCGTGTCCTTTCTGGAATGACATCAGCCAGTGTGGAAGAAGGGACTGTGCTGTCAAACC
ATGTCAATCTGATGAAGTTCCTGATGGAATTAAATCTGCGAGCTACAAGTATTCTGAAGA
AGCCAATAATCTCATTGAAGAATGTGAACAAGCTGAACGACTTGGAGCAGTGGATGAATC
TCTGAGTGAGGAAACACAGAAGGCTGTTCTTCAGTGGACCAAGCATGATGATTCTTCAGA
TAACTTCTGTGAAGCTGATGACATTCAGTCCCTGAAGCTGAATATGTAGATTTGCTTCT
TAATCCTGAGCGCTACACTGGTTACAAGGGACCAGATGCTTGGAAAATATGGAATGTCAT
CTACGAAGAAAACTGTTTTAAGCCACAGACAATTAAAAGACCTTTAAATCCTTTGGCTTC
TGGTCAAGGGACAAGTGAAGAGAACACTTTTTACAGTTGGCTAGAAGGTCTCTGTGTAGA
AAAAAGAGCATTCTACAGACTTATATCTGGCCTACATGCAAGCATTAATGTGCATTTGAG
TGCAAGATATCTTTTACAAGAGACCTGGTTAGAAAAGAAATGGGGACACAACATTACAGA
ATTTCAACAGCGATTTGATGGAATTTTGACTGAAGGAGAAGGTCCAAGAAGGCTTAAGAA
CTTGTATTTTCTCTACTTAATAGAACTAAGGGCTTTATCCAAAGTGTTACCATTCTTCGA
GCGCCCAGATTTTCAACTCTTTACTGGAAATAAAATTCAGGATGAGGAAAACAAAATGTT
ACTTCTGGAAATACTTCATGAAATCAAGTCATTTCCTTTGCATTTGATGAGAATTCATT
TTTTGCTGGGGATAAAAAAGAAGCACACAAACTAAAGGAGGACTTTCGACTGCATTTTAG
AAATATTTCAAGAATTATGGATTGTGTTGGTTGTTTTAAATGTCGTCTGTGGGAAAGCT
TCAGACTCAGGGTTTGGGCACTGCTCTGAAGATCTTATTTTCTGAGAAATTGATAGCAAA
TATGCCAGAAAGTGGACCTAGTTATGAATTCCATCTAACCAGACAAGAAATAGTATCATT
ATTCAACGCATTTGGAAGAATTTCTACAAGTGTGAAAGAATTAGAAAACTTCAGGAACTT
GTTACAGAATATTCATTAAAGAAAACAAGCTGATATGTGCCTGTTTCTGGACAATGGAGG
CGAAAGAGTGGAATTTCATTCAAAGGCATAATAGCAATGACAGTCTTAAGCCAAACATTT
TATATAAAGTTGCTTTTGTAAAGGAGAATTATATTGTTTTAAGTAAACACATTTTTAAAA
ATTGTGTTAAGTCTATGTATAATACTACTGTGAGTAAAGTAATACTTTAATAATGTGGT
ACAAATTTTAAAGTTTAATATTGAATAAAAGGAGGATTATCAAATTAAAAAAAAAAAAAA
AAAAAAAAAAAAAAAAAAAAAAAA
```

FIGURE 100

MGRGWGFLFGLLGAVWLLSSGHGEEQPPETAAQRCFCQVSGYLDDCTCDVETIDRFNNYR
LFPRLQKLLESDYFRYYKVNLKRPCPFWNDISQCGRRDCAVKPCQSDEVPDGIKSASYKY
SEEANNLIEECEQAERLGAVDESLSEETQKAVLQWTKHDDSSDNFCEADDIQSPEAEYVD
LLLNPERYTGYKGPDAWKIWNVIYEENCFKPQTIKRPLNPLASGQGTSEENTFYSWLEGL
CVEKRAFYRLISGLHASINVHLSARYLLQETWLEKKWGHNITEFQQRFDGILTEGEGPRR
LKNLYFLYLIELRALSKVLPFFERPDFQLFTGNKIQDEENKMLLLEILHEIKSFPLHFDE
NSFFAGDKKEAHKLKEDFRLHFRNISRIMDCVGCFKCRLWGKLQTQGLGTALKILFSEKL
IANMPESGPSYEFHLTRQEIVSLFNAFGRISTSVKELENFRNLLQNIH

Important features:
Signal peptide:
amino acids 1-23

N-glycosylation site:
amino acids 280-283 and 384-387

Amidation site:
amino acids 94-97

Glycosaminoglycan attachment site:
amino acids 20-23 and 223-226

Aminotransferases class-V pyridoxal-phosphate:
amino acids 216-222

Interleukin-7 proteins:
amino acids 338-343

FIGURE 101

```
GCCTAGCCAGGCCAAGAATGCAATTGCCCCGGTGGTGGGAGCTGGGAGACCCCTGTGCTT
GGACGGGACAGGGTCGGGGGACACGCAGGATGAGCCCCGCGACCACTGGCACATTCTTGC
TGACAGTGTACAGTATTTTCTCCAAGGTACACTCCGATCGGAATGTATACCCATCAGCAG
GTGTCCTCTTTGTTCATGTTTTGGAAAGAGAATATTTTAAGGGGGAATTTCCACCTTACC
CAAAACCTGGCGAGATTAGTAATGATCCCATAACATTTAATACAAATTTAATGGGTTACC
CAGACCGACCTGGATGGCTTCGATATATCCAAAGGACACCATATAGTGATGGAGTCCTAT
ATGGGTCCCCAACAGCTGAAAATGTGGGGAAGCCAACAATCATTGAGATAACTGCCTACA
ACAGGCGCACCTTTGAGACTGCAAGGCATAATTTGATAATTAATATAATGTCTGCAGAAG
ACTTCCCGTTGCCATATCAAGCAGAATTCTTCATTAAGAATATGAATGTAGAAGAAATGT
TGGCCAGTGAGGTTCTTGGAGACTTTCTTGGCGCAGTGAAAAATGTGTGGCAGCCAGAGC
GCCTGAACGCCATAAACATCACATCGGCCCTAGACAGGGGTGGCAGGGTGCCACTTCCCA
TTAATGACCTGAAGGAGGGCGTTTATGTCATGGTTGGTGCAGATGTCCCGTTTTCTTCTT
GTTTACGAGAAGTTGAAAATCCACAGAATCAATTGAGATGTAGTCAAGAAATGGAGCCTG
TAATAACATGTGATAAAAATTTCGTACTCAATTTTACATTGACTGGTGCAAAATTTCAT
TGGTTGATAAAACAAAGCAAGTGTCCACCTATCAGGAAGTGATTCGTGGAGAGGGGATTT
TACCTGATGGTGGAGAATACAAACCCCTTCTGATTCTTTGAAAAGCAGAGACTATTACA
CGGATTTCCTAATTACACTGGCTGTGCCCTCGGCAGTGGCACTGGTCCTTTTCTAATAC
TTGCTTATATCATGTGCTGCCGACGGGAAGGCGTGGAAAAGAGAAACATGCAAACACCAG
ACATCCAACTGGTCCATCACAGTGCTATTCAGAAATCTACCAAGGAGCTTCGAGACATGT
CCAAGAATAGAGAGATAGCATGGCCCCTGTCAACGCTTCCTGTGTTCCACCCTGTGACTG
GGGAAATCATACCTCCTTTACACACAGACAACTATGATAGCACAAACATGCCATTGATGC
AAACGCAGCAGAACTTGCCACATCAGACTCAGATTCCCCAACAGCAGACTACAGGTAAAT
GGTATCCCTGAAGAAAGAAAACTGACTGAAGCAATGAATTTATAATCAGACAATATAGCA
GTTACATCACATTTCTTTTCTCTTCCAATAATGCATGAGCTTTTCTGGCATATGTTATGC
ATGTTGGCAGTATTAAGTGTATACCAAATAATACAACATAACTTTCATTTTACTAATGTA
TTTTTTTGTACTTAAAGCATTTTGACAATTTGTAAACATTGATGACTTTATATTTGTT
ACAATAAAGTTGATCTTTAAAATAAATATTATTAATGAAGCCTAAAAAAAAAAA
```

FIGURE 102

```
MQLPRWWELGDPCAWTGQGRGTRRMSPATTGTFLLTVYSIFSKVHSDRNVYPSAGVLFVH
VLEREYFKGEFPPYPKPGEISNDPITFNTNLMGYPDRPGWLRYIQRTPYSDGVLYGSPTA
ENVGKPTIIEITAYNRRTFETARHNLIINIMSAEDFPLPYQAEFFIKNMNVEEMLASEVL
GDFLGAVKNVWQPERLNAINITSALDRGGRVPLPINDLKEGVYVMVGADVPFSSCLREVE
NPQNQLRCSQEMEPVITCDKKFRTQFYIDWCKISLVDKTKQVSTYQEVIRGEGILPDGGE
YKPPSDSLKSRDYYTDFLITLAVPSAVALVLFLILAYIMCCRREGVEKRNMQTPDIQLVH
HSAIQKSTKELRDMSKNREIAWPLSTLPVFHPVTGEIIPPLHTDNYDSTNMPLMQTQQNL
PHQTQIPQQQTTGKWYP
``` signal sequence:
Amino acids 1-46 transmembrane domain:
Amino acids 319-338

N-glycosylation site:
Amino acids 200-204 cAMP- and cGMP-dependent protein kinase phosphorylation site:
Amino acids 23-27

Tyrosine kinase phosphorylation site:
Amino acids 43-52

N-myristoylation sites:
Amino acids 17-23;112-118;116-122;185-191

FIGURE 103

```
CAGAAGAGGGGGCTAGCTAGCTGTCTCTGCGGACCAGGGAGACCCCCGCGCCCCCCGGT
GTGAGGCGGCCTCACAGGGCCGGGTGGGCTGGCGAGCCGACGCGGCGGCGGAGGAGGCTG
TGAGGAGTGTGTGGAACAGGACCCGGGACAGAGGAACCATGGCTCCGCAGAACCTGAGCA
CCTTTTGCCTGTTGCTGCTATACCTCATCGGGGCGGTGATTGCCGGACGAGATTTCTATA
AGATCTTGGGGGTGCCTCGAAGTGCCTCTATAAAGGATATTAAAAAGGCCTATAGGAAAC
TAGCCCTGCAGCTTCATCCCGACCGGAACCCTGATGATCCACAAGCCCAGGAGAAATTCC
AGGATCTGGGTGCTGCTTATGAGGTTCTGTCAGATAGTGAGAAACGGAAACAGTACGATA
CTTATGGTGAAGAAGGATTAAAAGATGGTCATCAGAGCTCCCATGGAGACATTTTTTCAC
ACTTCTTTGGGGATTTTGGTTTCATGTTTGGAGGAACCCCTCGTCAGCAAGACAGAAATA
TTCCAAGAGGAAGTGATATTATTGTAGATCTAGAAGTCACTTTGGAAGAAGTATATGCAG
GAAATTTTGTGGAAGTAGTTAGAAACAAACCTGTGGCAAGGCAGGCTCCTGGCAAACGGA
AGTGCAATTGTCGGCAAGAGATGCGGACCACCCAGCTGGGCCCTGGGCGCTTCCAAATGA
CCCAGGAGGTGGTCTGCGACGAATGCCCTAATGTCAAACTAGTGAATGAAGAACGAACGC
TGGAAGTAGAAATAGAGCCTGGGGTGAGAGACGGCATGGAGTACCCCTTTATTGGAGAAG
GTGAGCCTCACGTGGATGGGGAGCCTGGAGATTTACGGTTCCGAATCAAAGTTGTCAAGC
ACCCAATATTTGAAAGGAGAGGAGATGATTTGTACACAAATGTGACAATCTCATTAGTTG
AGTCACTGGTTGGCTTTGAGATGGATATTACTCACTTGGATGGTCACAAGGTACATATTT
CCCGGGATAAGATCACCAGGCCAGGAGCGAAGCTATGGAAGAAAGGGGAAGGGCTCCCCA
ACTTTGACAACAACAATATCAAGGGCTCTTTGATAATCACTTTTGATGTGGATTTTCCAA
AAGAACAGTTAACAGAGGAAGCGAGAGAAGGTATCAAACAGCTACTGAAACAAGGGTCAG
TGCAGAAGGTATACAATGGACTGCAAGGATATTGAGAGTGAATAAAATTGGACTTTGTTT
AAAATAAGTGAATAAGCGATATTTATTATCTGCAAGGTTTTTTTGTGTGTGTTTTTGTTT
TTATTTTCAATATGCAAGTTAGGCTTAATTTTTTTATCTAATGATCATCATGAAATGAAT
AAGAGGGCTTAAGAATTTGTCCATTTGCATTCGGAAAAGAATGACCAGCAAAAGGTTTAC
TAATACCTCTCCCTTTGGGGATTTAATGTCTGGTGCTGCCGCCTGAGTTTCAAGAATTAA
AGCTGCAAGAGGACTCCAGGAGCAAAAGAAACACAATATAGAGGGTTGGAGTTGTTAGCA
ATTTCATTCAAAATGCCAACTGGAGAAGTCTGTTTTAAATACATTTTGTTGTTATTTTA
```

FIGURE 104

```
MAPQNLSTFCLLLLYLIGAVIAGRDFYKILGVPRSASIKDIKKAYRKLALQLHPDRNPDD
PQAQEKFQDLGAAYEVLSDSEKRKQYDTYGEEGLKDGHQSSHGDIFSHFFGDFGFMFGGT
PRQQDRNIPRGSDIIVDLEVTLEEVYAGNFVEVVRNKPVARQAPGKRKCNCRQEMRTTQL
GPGRFQMTQEVVCDECPNVKLVNEERTLEVEIEPGVRDGMEYPFIGEGEPHVDGEPGDLR
FRIKVVKHPIFERRGDDLYTNVTISLVESLVGFEMDITHLDGHKVHISRDKITRPGAKLW
KKGEGLPNFDNNNIKGSLIITFDVDFPKEQLTEEAREGIKQLLKQGSVQKVYNGLQGY
```

Important features:
Signal peptide:
amino acids 1-22

Cell attachment sequence:
amino acids 254-257

Nt-dnaJ domain signature:
amino acids 67-87

Homologous region to Nt-dnaJ domain proteins:
 amino acids 26-58

N-glycosylation site:
amino acids 5-9, 261-265

Tyrosine kinase phosphorylation site:
amino acids 253-260

N-myristoylation site:
amino acids 18-24, 31-37, 93-99, 215-221

Amidation site:
amino acids 164-168

FIGURE 105

```
GGCACGAGGCGGCGGGGCAGTCGCGGGATGCGCCCGGGAGCCACAGCCTGAGGCCCTCAG
GTCTCTGCAGGTGTCGTGGAGGAACCTAGCACCTGCCATCCTCTTCCCCAATTTGCCACT
TCCAGCAGCTTTAGCCCATGAGGAGGATGTGACCGGGACTGAGTCAGGAGCCCTCTGGAA
GCATGGAGACTGTGGTGATTGTTGCCATAGGTGTGCTGGCCACCATCTTTCTGGCTTCGT
TTGCAGCCTTGGTGCTGGTTTGCAGGCAGCGCTACTGCCGGCCGCGAGACCTGCTGCAGC
GCTATGATTCTAAGCCCATTGTGGACCTCATTGGTGCCATGGAGACCCAGTCTGAGCCCT
CTGAGTTAGAACTGGACGATGTCGTTATCACCAACCCCACATTGAGGCCATTCTGGAGA
ATGAAGACTGGATCGAAGATGCCTCGGGTCTCATGTCCCACTGCATTGCCATCTTGAAGA
TTTGTCACACTCTGACAGAGAAGCTTGTTGCCATGACAATGGGCTCTGGGGCCAAGATGA
AGACTTCAGCCAGTGTCAGCGACATCATTGTGGTGGCCAAGCGGATCAGCCCCAGGGTGG
ATGATGTTGTGAAGTCGATGTACCCTCCGTTGGACCCCAAACTCCTGGACGCACGGACGA
CTGCCCTGCTCCTGTCTGTCAGTCACCTGGTGCTGGTGACAAGGAATGCCTGCCATCTGA
CGGGAGGCCTGGACTGGATTGACCAGTCTCTGTCGGCTGCTGAGGAGCATTTGGAAGTCC
TTCGAGAAGCAGCCCTAGCTTCTGAGCCAGATAAAGGCCTCCCAGGCCCTGAAGGCTTCC
TGCAGGAGCAGTCTGCAATTTAGTGCCTACAGGCCAGCAGCTAGCCATGAAGGCCCCTGC
CGCCATCCCTGGATGGCTCAGCTTAGCCTTCTACTTTTTCCTATAGAGTTAGTTGTTCTC
CACGGCTGGAGAGTTCAGCTGTGTGTGCATAGTAAAGCAGGAGATCCCCGTCAGTTTATG
CCTCTTTTGCAGTTGCAAACTGTGGCTGGTGAGTGGCAGTCTAATACTACAGTTAGGGGA
GATGCCATTCACTCTCTGCAAGAGGAGTATTGAAAACTGGTGGACTGTCAGCTTTATTTA
GCTCACCTAGTGTTTTCAAGAAAATTGAGCCACCGTCTAAGAAATCAAGAGGTTTCACAT
TAAAATTAGAATTTCTGGCCTCTCTCGATCGGTCAGAATGTGTGGCAATTCTGATCTGCA
TTTTCAGAAGAGGACAATCAATTGAAACTAAGTAGGGGTTTCTTCTTTTGGCAAGACTTG
TACTCTCTCACCTGGCCTGTTTCATTTATTTGTATTATCTGCCTGGTCCCTGAGGCGTCT
GGGTCTCTCCTCTCCCTTGCAGGTTTGGGTTTGAAGCTGAGGAACTACAAAGTTGATGAT
TTCTTTTTTATCTTTATGCCTGCAATTTTACCTAGCTACCACTAGGTGGATAGTAAATTT
ATACTTATGTTTCCCTCAAAAAAAAAAAAAAA
```

FIGURE 106

METVVIVAIGVLATIFLASFAALVLVCRQRYCRPRDLLQRYDSKPIVDLIGAMETQSEPS
ELELDDVVITNPHIEAILENEDWIEDASGLMSHCIAILKICHTLTEKLVAMTMGSGAKMK
TSASVSDIIVVAKRISPRVDDVVKSMYPPLDPKLLDARTTALLLSVSHLVLVTRNACHLT
GGLDWIDQSLSAAEEHLEVLREAALASEPDKGLPGPEGFLQEQSAI

FIGURE 107

```
GCTTCATTTCTCCCGACTCAGCTTCCCACCCTGGGCTTTCCGAGGTGCTTTCGCCGCTGT
CCCCACCACTGCAGCCATGATCTCCTTAACGGACACGCAGAAAATTGGAATGGGATTAAC
AGGATTTGGAGTGTTTTTCCTGTTCTTTGGAATGATTCTCTTTTTTGACAAAGCACTACT
GGCTATTGGAAATGTTTTATTTGTAGCCGGCTTGGCTTTTGTAATTGGTTTAGAAAGAAC
ATTCAGATTCTTCTTCCAAAAACATAAAATGAAAGCTACAGGTTTTTTTCTGGGTGGTGT
ATTTGTAGTCCTTATTGGTTGGCCTTTGATAGGCATGATCTTCGAAATTTATGGATTTTT
TCTCTTGTTCAGGGGCTTCTTTCCTGTCGTTGTTGGCTTTATTAGAAGAGTGCCAGTCCT
TGGATCCCTCCTAAATTTACCTGGAATTAGATCATTTGTAGATAAAGTTGGAGAAAGCAA
CAATATGGTATAACAACAAGTGAATTTGAAGACTCATTTAAAATATTGTGTTATTTATAA
AGTCATTTGAAGAATATTCAGCACAAAATTAAATTACATGAAATAGCTTGTAATGTTCTT
TACAGGAGTTTAAAACGTATAGCCTACAAAGTACCAGCAGCAAATTAGCAAAGAAGCAGT
GAAAACAGGCTTCTACTCAAGTGAACTAAGAAGAAGTCAGCAAGCAAACTGAGAGAGGTG
AAATCCATGTTAATGATGCTTAAGAAACTCTTGAAGGCTATTTGTGTTGTTTTCCACAA
TGTGCGAAACTCAGCCATCCTTAGAGAACTGTGGTGCCTGTTTCTTTTCTTTTTATTTTG
AAGGCTCAGGAGCATCCATAGGCATTTGCTTTTTAGAAGTGTCCACTGCAATGGCAAAAA
TATTTCCAGTTGCACTGTATCTCTGGAAGTGATGCATGAATTCGATTGGATTGTGTCATT
TTAAAGTATTAAAACCAAGGAAACCCCAATTTTGATGTATGGATTACTTTTTTTTGNGCN
CAGGGCC
```

FIGURE 108

MISLTDTQKIGMGLTGFGVFFLFFGMILFFDKALLAIGNVLFVAGLAFVIGLERTFRFFF
QKHKMKATGFFLGGVFVVLIGWPLIGMIFEIYGFFLLFRGFFPVVVGFIRRVPVLGSLLN
LPGIRSFVDKVGESNNMV

Important features:
Transmembrane domains:
amino acids 12-30 (typeII), 33-52, 69-89 and 93-109

N-myristoylation sites:
amino acids 11-16, 51-56 and 116-121

Aminoacyl-transfer RNA synthetases class-II protein:
amino acids 49-59

FIGURE 109

CCAGTCTGTCGCCACCTCACTTGGTGTCTGCTGTCCCCGCCAGGCAAGCCTGGGGTGAGA
GCACAGAGGAGTGGGCCGGGACCATGCGGGGGACGCGGCTGGCGCTCCTGGCGCTGGTGC
TGGCTGCCTGCGGAGAGCTGGCGCCGGCCCTGCGCTGCTACGTCTGTCCGGAGCCCACAG
GAGTGTCGGACTGTGTCACCATCGCCACCTGCACCACCAACGAAACCATGTGCAAGACCA
CACTCTACTCCCGGGAGATAGTGTACCCCTTCCAGGGGGACTCCACGGTGACCAAGTCCT
GTGCCAGCAAGTGTAAGCCCTCGGATGTGGATGGCATCGGCCAGACCCTGCCCGTGTCCT
GCTGCAATACTGAGCTGTGCAATGTAGACGGGGCGCCCGCTCTGAACAGCCTCCACTGCG
GGGCCCTCACGCTCCTCCCACTCTTGAGCCTCCGACTGTAGAGTCCCCGCCCACCCCCAT
GGCCCTATGCGGCCCAGCCCCGAATGCCTTGAAGAAGTGCCCCCTGCACCAGGAAAAAAA
AAAAAAAAA

FIGURE 110

MRGTRLALLALVLAACGELAPALRCYVCPEPTGVSDCVTIATCTTNETMCKTTLYSREIV
YPFQGDSTVTKSCASKCKPSDVDGIGQTLPVSCCNTELCNVDGAPALNSLHCGALTLLPL
LSLRL

Important features:
Signal peptide:
amino acids 1-17

N-glycosylation site:
amino acids 46-49

FIGURE 111

```
GCGCCGCCAGGCGTAGGCGGGGTGGCCCTTGCGTCTCCCGCTTCCTTGAAAAACCCGGCG
GGCGAGCGAGGCTGCGGGCCGGCCGCTGCCCTTCCCCACACTCCCCGCCGAGAAGCCTCG
CTCGGCGCCCAACATGGCGGGTGGGCGCTGCGGCCCGCAGCTAACGGCGCTCCTGGCCGC
CTGGATCGCGGCTGTGGCGGCGACGGCAGGCCCCGAGGAGGCCGCGCTGCCGCCGGAGCA
GAGCCGGGTCCAGCCCATGACCGCCTCCAACTGGACGCTGGTGATGGAGGGCGAGTGGAT
GCTGAAATTTTACGCCCATGGTGTCCATCCTGCCAGCAGACTGATTCAGAATGGGAGGC
TTTTGCAAAGAATGGTGAAATACTTCAGATCAGTGTGGGAAGGTAGATGTCATTCAAGA
ACCAGGTTTGAGTGGCCGCTTCTTTGTCACCACTCTCCCAGCATTTTTTCATGCAAAGGA
TGGGATATTCCGCCGTTATCGTGGCCCAGGAATCTTCGAAGACCTGCAGAATTATATCTT
AGAGAAGAAATGGCAATCAGTCGAGCCTCTGACTGGCTGGAAATCCCCAGCTTCTCTAAC
GATGTCTGGAATGGCTGGTCTTTTAGCATCTCTGGCAAGATATGGCATCTTCACAACTA
TTTCACAGTGACTCTTGGAATTCCTGCTTGGTGTTCTTATGTGTTTTCGTCATAGCCAC
CTTGGTTTTTGGCCTTTTTATGGGTCTGGTCTTGGTGGTAATATCAGAATGTTTCTATGT
GCCACTTCCAAGGCATTTATCTGAGCGTTCTGAGCAGAATCGGAGATCAGAGGAGGCTCA
TAGAGCTGAACAGTTGCAGGATGCGGAGGAGGAAAAGATGATTCAAATGAAGAAGAAAA
CAAAGACAGCCTTGTAGATGATGAAGAAGAGAAAGAAGATCTTGGCGATGAGGATGAAGC
AGAGGAAGAAGAGGAGGAGGACAACTTGGCTGCTGGTGTGGATGAGGAGAGAAGTGAGGC
CAATGATCAGGGGCCCCAGGAGAGGACGGTGTGACCCGGGAGGAAGTAGAGCCTGAGGA
GGCTGAAGAAGGCATCTCTGAGCAACCCTGCCCAGCTGACACAGAGGTGGTGGAAGACTC
CTTGAGGCAGCGTAAAAGTCAGCATGCTGACAAGGGACTGTAGATTTAATGATGCGTTTT
CAAGAATACACACCAAAACAATATGTCAGCTTCCCTTTGGCCTGCAGTTTGTACCAAATC
CTTAATTTTTCCTGAATGAGCAAGCTTCTCTTAAAAGATGCTCTCTAGTCATTTGGTCTC
ATGGCAGTAAGCCTCATGTATACTAAGGAGAGTCTTCCAGGTGTGACAATCAGGATATAG
AAAAACAAACGTAGTGTTGGGATCTGTTTGGAGACTGGGATGGGAACAAGTTCATTTACT
TAGGGGTCAGAGAGTCTCGACCAGAGGAGGCCATTCCCAGTCCTAATCAGCACCTTCCAG
AGACAAGGCTGCAGGCCCTGTGAAATGAAAGCCAAGCAGGAGCCTTGGCTCCTGAGCATC
CCCAAAGTGTAACGTAGAAGCCTTGCATCCTTTTCTTGTGTAAAGTATTTATTTTTGTCA
AATTGCAGGAAACATCAGGCACCACAGTGCATGAAAAATCTTTCACAGCTAGAAATTGAA
AGGGCCTTGGGTATAGAGAGCAGCTCAGAAGTCATCCCAGCCCTCTGAATCTCCTGTGCT
ATGTTTTATTTCTTACCTTTAATTTTTCCAGCATTTCCACCATGGGCATTCAGGCTCTCC
ACACTCTTCACTATTATCTCTTGGTCAGAGGACTCCAATAACAGCCAGGTTTACATGAAC
TGTGTTTGTTCATTCTGACCTAAGGGGTTTAGATAATCAGTAACCATAACCCCTGAAGCT
GTGACTGCCAAACATCTCAAATGAAATGTTGTGGCCATCAGAGACTCAAAAGGAAGTAAG
GATTTTACAAGACAGATTAAAAAAAAATTGTTTTGTCCAAAATATAGTTGTTGTTGATTT
TTTTTTAAGTTTTCTAAGCAATATTTTTCAAGCCAGAAGTCCTCTAAGTCTTGCCAGTAC
AAGGTAGTCTTGTGAAGAAAGTTGAATACTGTTTTGTTTTCATCTCAAGGGGTTCCCTG
GGTCTTGAACTACTTTAATAATAACTAAAAACCACTTCTGATTTTCCTTCAGTGATGTG
CTTTTGGTGAAAGAATTAATGAACTCCAGTACCTGAAAGTGAAAGATTTGATTTTGTTTC
CATCTTCTGTAATCTTCCAAAGAATTATATCTTTGTAAATCTCTCAATACTCAATCTACT
GTAAGTACCCAGGGAGGCTAATTTCTTT
```

FIGURE 112

```
MAGGRCGPQLTALLAAWIAAVAATAGPEEAALPPEQSRVQPMTASNWTLVMEGEWMLKFY
APWCPSCQQTDSEWEAFAKNGEILQISVGKVDVIQEPGLSGRFFVTTLPAFFHAKDGIFR
RYRGPGIFEDLQNYILEKKWQSVEPLTGWKSPASLTMSGMAGLFSISGKIWHLHNYFTVT
LGIPAWCSYVFFVIATLVFGLFMGLVLVVISECFYVPLPRHLSERSEQNRRSEEAHRAEQ
LQDAEEEKDDSNEEENKDSLVDDEEEKEDLGDEDEAEEEEEDNLAAGVDEERSEANDQG
PPGEDGVTREEVEPEEAEEGISEQPCPADTEVVEDSLRQRKSQHADKGL
```

Important features:
Signal peptide:
amino acids 1-22

Transmembrane domain:
amino acids 191-211

N-glycosylation site:
amino acids 46-49

Thioredoxin family proteins:  (homologous region to disulfide isomerase)
amino acids 56-72

Flavodoxin proteins:
amino acids 173-187

FIGURE 113

```
GAGGAACCTACCGGTACCGGCCGCGCGCTGGTAGTCGCCGGTGTGGCTGCACCTCACCAA
TCCCGTGCGCCGCGGCTGGGCCGTCGGAGAGTGCGTGTGCTTCTCTCCTGCACGCGGTGC
TTGGGCTCGGCCAGGCGGGGTCCGCCGCCAGGGTTTGAGGATGGGGGAGTAGCTACAGGA
AGCGACCCCGCGATGGCAAGGTATATTTTTGTGGAATGAAAAGGAAGTATTAGAAATGAG
CTGAAGACCATTCACAGATTAATATTTTGGGGACAGATTTGTGATGCTTGATTCACCCT
TGAAGTAATGTAGACAGAAGTTCTCAAATTTGCATATTACATCAACTGGAACCAGCAGTG
AATCTTAATGTTCACTTAAATCAGAACTTGCATAAGAAAGAGAATGGGAGTCTGGTTAAA
TAAAGATGACTATATCAGAGACTTGAAAGGATCATTCTCTGTTTTCTGATAGTGTATAT
GGCCATTTTAGTGGGCACAGATCAGGATTTTTACAGTTTACTTGGAGTGTCCAAAACTGC
AAGCAGTAGAGAAATAAGACAAGCTTTCAAGAAATTGGCATTGAAGTTACATCCTGATAA
AAACCCGAATAACCCAAATGCACATGGCGATTTTTTAAAAATAAATAGAGCATATGAAGT
ACTCAAAGATGAAGATCTACGGAAAAGTATGACAAATATGGAGAAAGGGACTTGAGGA
TAATCAAGGTGGCCAGTATGAAAGCTGGAACTATTATCGTTATGATTTGGTATTTATGA
TGATGATCCTGAAATCATAACATTGGAAAGAAGAGAATTTGATGCTGCTGTTAATTCTGG
AGAACTGTGGTTTGTAAATTTTTACTCCCCAGGCTGTTCACACTGCCATGATTTAGCTCC
CACATGGAGAGACTTTGCTAAAGAAGTGGATGGGTTACTTCGAATTGGAGCTGTTAACTG
TGGTGATGATAGAATGCTTTGCCGAATGAAAGGAGTCAACAGCTATCCCAGTCTCTTCAT
TTTTCGGTCTGGAATGGCCCCAGTGAAATATCATGGAGACAGATCAAGGAGAGTTTAGT
GAGTTTTGCAATGCAGCATGTTAGAAGTACAGTGACAGAACTTTGGACAGGAAATTTTGT
CAACTCCATACAAACTGCTTTTGCTGCTGGTATTGGCTGGCTGATCACTTTTTGTTCAAA
AGGAGGAGATTGTTTGACTTCACAGACACGACTCAGGCTTAGTGGCATGTTGTTTCTCAA
CTCATTGGATGCTAAAGAAATATATTTGGAAGTAATACATAATCTTCCAGATTTTGAACT
ACTTTCGGCAAACACACTAGAGGATCGTTTGGCTCATCATCGGTGGCTGTTATTTTTTCA
TTTTGGAAAAAATGAAAATTCAAATGATCCTGAGCTGAAAAAACTAAAAACTCTACTTAA
AAATGATCATATTCAAGTTGGCAGGTTTGACTGTTCCTCTGCACCAGACATCTGTAGTAA
TCTGTATGTTTTTCAGCCGTCTCTAGCAGTATTTAAAGGACAAGGAACCAAAGAATATGA
AATTCATCATGGAAAGAAGATTCTATATGATATACTTGCCTTTGCCAAAGAAAGTGTGAA
TTCTCATGTTACCACGCTTGGACCTCAAAATTTTCCTGCCAATGACAAAGAACCATGGCT
TGTTGATTTCTTTGCCCCCTGGTGTCCACCATGTCGAGCTTTACTACCAGAGTTACGAAG
AGCATCAAATCTTCTTTATGGTCAGCTTAAGTTTGGTACACTAGATTGTACAGTTCATGA
GGGACTCTGTAACATGTATAACATTCAGGCTTATCCAACAACAGTGGTATTCAACCAGTC
CAACATTCATGAGTATGAAGGACATCACTCTGCTGAACAAATCTTGGAGTTCATAGAGGA
TCTTATGAATCCTTCAGTGGTCTCCCTTACACCCACCACCTTCAACGAACTAGTTACACA
AAGAAAACACAACGAAGTCTGGATGGTTGATTTCTATTCTCCGTGGTGTCATCCTTGCCA
AGTCTTAATGCCAGAATGGAAAGAATGGCCCGGACATTAACTGGACTGATCAACGTGGG
CAGTATAGATTGCCAACAGTATCATTCTTTTGTGCCCAGGAAAACGTTCAAAGATACCC
TGAGATAAGATTTTTTCCCCAAAATCAAATAAAGCTTATCAGTATCACAGTTACAATGG
TTGGAATAGGGATGCTTATTCCCTGAGAATCTGGGGTCTAGGATTTTTACCTCAAGTATC
CACAGATCTAACACCTCAGACTTTCAGTGAAAAGTTCTACAAGGGAAAATCATTGGGT
GATTGATTTCTATGCTCCTTGGTGTGGACCTTGCCAGAATTTTGCTCCAGAATTTGAGCT
CTTGGCTAGGATGATTAAAGGAAAGTGAAAGCTGGAAAGTAGACTGTCAGGCTTATGC
TCAGACATGCCAGAAAGCTGGGATCAGGGCCTATCCAACTGTTAAGTTTTATTTCTACGA
AAGAGCAAAGAGAAATTTTCAAGAAGAGCAGATAAATACCAGAGATGCAAAAGCAATCGC
TGCCTTAATAAGTGAAAAATTGGAAACTCTCCGAAATCAAGGCAAGAGGAATAAGGATGA
ACTTTGATAATGTTGAAGATGAAGAAAAAGTTTAAAAGAAATTCTGACAGATGACATCAG
AAGACACCTATTTAGAATGTTACATTTATGATGGGAATGAATGAACATTATCTTAGACTT
```

FIGURE 113
(continued)

```
GCAGTTGTACTGCCAGAATTATCTACAGCACTGGTGTAAAAGAAGGGTCTGCAAACTTTT
TCTGTAAAGGGCCGGTTTATAAATATTTTAGACTTTGCAGGCTATAATATATGGTTCACA
CATGAGAACAAGAATAGAGTCATCATGTATTCTTTGTTATTTGCTTTTAACAACCTTTAA
AAAATATTAAAACGATTCTTAGCTCAGAGCCATACAAAAGTAGGCTGGATTCAGTCCATG
GACCATAGATTGCTGTCCCCCTCGACGGACTTATAATGTTTCAGGTGGCTGGCTTGAACA
TGAGTCTGCTGTGCTATCTACATAAATGTCTAAGTTGTATAAAGTCCACTTTCCCTTCAC
GTTTTTTGGCTGACCTGAAAAGAGGTAACTTAGTTTTTGGTCACTTGTTCTCCTAAAAAT
GCTATCCCTAACCATATATTTATATTTCGTTTTAAAAACACCCATGATGTGGCACAGTAA
ACAAACCCTGTTATGCTGTATTATTATGAGGAGATTCTTCATTGTTTTCTTTCCTTCTCA
AAGGTTGAAAAAATGCTTTTAATTTTTCACAGCCGAGAAACAGTGCAGCAGTATATGTGC
ACACAGTAAGTACACAAATTTGAGCAACAGTAAGTGCACAAATTCTGTAGTTTGCTGTAT
CATCCAGGAAAACCTGAGGGAAAAAAATTATAGCAATTAACTGGGCATTGTAGAGTATCC
TAAATATGTTATCAAGTATTTAGAGTTCTATATTTTAAAGATATATGTGTTCATGTATTT
TCTGAAATTGCTTTCATAGAAATTTTCCCACTGATAGTTGATTTTTGAGGCATCTAATAT
TTACATATTTGCCTTCTGAACTTTGTTTTGACCTGTATCCTTTATTTACATTGGGTTTTT
CTTTCATAGTTTTGGTTTTTCACTCCTGTCCAGTCTATTTATTATTCAAATAGGAAAAAT
TACTTTACAGGTTGTTTTACTGTAGCTTATAATGATACTGTAGTTATTCCAGTTACTAGT
TTACTGTCAGAGGGCTGCCTTTTTCAGATAAATATTGACATAATAACTGAAGTTATTTTT
ATAAGAAAATCAAGTATATAAATCTAGGAAAGGGATCTTCTAGTTTCTGTGTTGTTTAGA
CTCAAAGAATCACAAATTTGTCAGTAACATGTAGTTGTTTAGTTATAATTCAGAGTGTAC
AGAATGGTAAAAATTCCAATCAGTCAAAAGAGGTCAATGAATTAAAAGGCTTGCAACTTT
TTCAAAAAAAAAAAAAAAAA
```

FIGURE 114

MGVWLNKDDYIRDLKRIILCFLIVYMAILVGTDQDFYSLLGVSKTASSREIRQAFKKLAL
KLHPDKNPNNPNAHGDFLKINRAYEVLKDEDLRKKYDKYGEKGLEDNQGGQYESWNYYRY
DFGIYDDDPEIITLERREFDAAVNSGELWFVNFYSPGCSHCHDLAPTWRDFAKEVDGLLR
IGAVNCGDDRMLCRMKGVNSYPSLFIFRSGMAPVKYHGDRSKESLVSFAMQHVRSTVTEL
WTGNFVNSIQTAFAAGIGWLITFCSKGGDCLTSQTRLRLSGMLFLNSLDAKEIYLEVIHN
LPDFELLSANTLEDRLAHHRWLLFFHFGKNENSNDPELKKLKTLLKNDHIQVGRFDCSSA
PDICSNLYVFQPSLAVFKGQGTKEYEIHHGKKILYDILAFAKESVNSHVTTLGPQNFPAN
DKEPWLVDFFAPWCPPCRALLPELRRASNLLYGQLKFGTLDCTVHEGLCNMYNIQAYPTT
VVFNQSNIHEYEGHHSAEQILEFIEDLMNPSVVSLTPTTFNELVTQRKHNEVWMVDFYSP
WCHPCQVLMPEWKRMARTLTGLINVGSIDCQQYHSFCAQENVQRYPEIRFFPPKSNKAYQ
YHSYNGWNRDAYSLRIWGLGFLPQVSTDLTPQTFSEKVLQGKNHWVIDFYAPWCGPCQNF
APEFELLARMIKGKVKAGKVDCQAYAQTCQKAGIRAYPTVKFYFYERAKRNFQEEQINTR
DAKAIAALISEKLETLRNQGKRNKDEL

```
Important features:
Endoplasmic reticulum targeting sequence:
amino acids 744-747

Cytochrome c family heme-binding site signature:
amino acids 158-163

Nt-dnaJ domain signature:
amino acids 77-96

N-glycosylation site:
amino acids 484-487
```

FIGURE 115

```
GCGGGCTGTTGACGGCGCTGCGATGGCTGCCTGCGAGGGCAGGAGAAGCGGAGCTCTCGG
TTCCTCTCAGTCGGACTTCCTGACGCCGCCAGTGGGCGGGGCCCCTTGGGCCGTCGCCAC
CACTGTAGTCATGTACCCACCGCCGCCGCCGCCTCATCGGGACTTCATCTCGGTGAC
GCTGAGCTTTGGCGAGAGCTATGACAACAGCAAGAGTTGGCGGCGGCGCTCGTGCTGGAG
GAAATGGAAGCAACTGTCGAGATTGCAGCGGAATATGATTCTCTTCCTCCTTGCCTTTCT
GCTTTTCTGTGGACTCCTCTTCTACATCAACTTGGCTGACCATTGGAAAGCTCTGGCTTT
CAGGCTAGAGGAAGAGCAGAAGATGAGGCCAGAAATTGCTGGGTTAAAACCAGCAAATCC
ACCCGTCTTACCAGCTCCTCAGAAGGCGGACACCGACCCTGAGAACTTACCTGAGATTTC
GTCACAGAAGACACAAAGACACATCCAGCGGGGACCACCTCACCTGCAGATTAGACCCCC
AAGCCAAGACCTGAAGGATGGGACCCAGGAGGAGGCCACAAAAGGCAAGAAGCCCCTGT
GGATCCCCGCCCGGAAGGAGATCCGCAGAGGACAGTCATCAGCTGGAGGGGAGCGGTGAT
CGAGCCTGAGCAGGGCACCGAGCTCCCTTCAAGAAGAGCAGAAGTGCCCACCAAGCCTCC
CCTGCCACCGGCCAGGACACAGGGCACACCAGTGCATCTGAACTATCGCCAGAAGGGCGT
GATTGACGTCTTCCTGCATGCATGGAAAGGATACCGCAAGTTTGCATGGGCCATGACGA
GCTGAAGCCTGTGTCCAGGTCCTTCAGTGAGTGGTTTGGCCTCGGTCTCACACTGATCGA
CGCGCTGGACACCATGTGGATCTTGGGTCTGAGGAAAGAATTTGAGGAAGCCAGGAAGTG
GGTGTCGAAGAAGTTACACTTTGAAAAGGACGTGGACGTCAACCTGTTTGAGAGCACGAT
CCGCATCCTGGGGGGGCTCCTGAGTGCCTACCACCTGTCTGGGGACAGCCTCTTCCTGAG
GAAAGCTGAGGATTTTGGAAATCGGCTAATGCCTGCCTTCAGAACACCATCCAAGATTCC
TTACTCGGATGTGAACATCGGTACTGGAGTTGCCCACCCGCCACGGTGGACCTCCGACAG
CACTGTGGCCGAGGTGACCAGCATTCAGCTGGAGTTCCGGGAGCTCTCCCGTCTCACAGG
GGATAAGAAGTTTCAGGAGGCAGTGGAGAAGGTGACACAGCACATCCACGGCCTGTCTGG
GAAGAAGGATGGGCTGGTGCCCATGTTCATCAATACCCACAGTGGCCTCTTCACCCACCT
GGGCGTATTCACGCTGGGCGCCAGGGCCGACAGCTACTATGAGTACCTGCTGAAGCAGTG
GATCCAGGGCGGGAAGCAGGAGACACAGCTGCTGGAAGACTACGTGGAAGCCATCGAGGG
TGTCAGAACGCACCTGCTGCGGCACTCCGAGCCCAGTAAGCTCACCTTTGTGGGGAGCT
TGCCCACGGCCGCTTCAGTGCCAAGATGGACCACCTGGTGTGCTTCCTGCCAGGGACGCT
GGCTCTGGGCGTCTACCACGGCCTGCCCGCCAGCCACATGGAGCTGGCCCAGGAGCTCAT
GGAGACTTGTTACCAGATGAACCGGCAGATGGAGACGGGGCTGAGTCCCGAGATCGTGCA
CTTCAACCTTTACCCCCAGCCGGGCCGTCGGGACGTGGAGGTCAAGCCAGCAGACAGGCA
CAACCTGCTGCGGCCAGAGACCGTGGAGAGCCTGTTCTACCTGTACCGCGTCACAGGGGA
CCGCAAATACCAGGACTGGGGCTGGGAGATTCTGCAGAGCTTCAGCCGATTCACACGGGT
CCCCTCGGGTGGCTATTCTTCCATCAACAATGTCCAGGATCCTCAGAAGCCCGAGCCTAG
GGACAAGATGGAGAGCTTCTTCCTGGGGGAGACGCTCAAGTATCTGTTCTTGCTCTTCTC
CGATGACCCAAACCTGCTCAGCCTGGACGCCTACGTGTTCAACACCGAAGCCCACCCTCT
GCCTATCTGGACCCCTGCCTAGGGTGGATGGCTGCTGGTGTGGGGACTTCGGGTGGGCAG
AGGCACCTTGCTGGGTCTGTGGCATTTTCCAAGGGCCCACGTAGCACCGGCAACCGCCAA
GTGGCCCAGGCTCTGAACTGGCTCTGGGCTCCTCCTCGTCTCTGCTTTAATCAGGACACC
GTGAGGACAAGTGAGGCCGTCAGTCTTGGTGTGATGCGGGTGGGCTGGCCGCTGGAGC
CTCCGCCTGCTTCCTCCAGAAGACACGAATCATGACTCACGATTGCTGAAGCCTGAGCAG
GTCTCTGTGGGCCGACCAGAGGGGGCTTCGAGGTGGTCCCTGGTACTGGGGTGACCGAG
TGGACAGCCCAGGGTGCAGCTCTGCCCGGGCTCGTGAAGCCTCAGATGTCCCCAATCCAA
GGGTCTGGAGGGGCTGCCGTGACTCCAGAGGCCTGAGGCTCCAGGGCTGGCTCTGGTGTT
TACAAGCTGGACTCAGGGATCCTCCTGGCCGCCCCGCAGGGGCTTGGAGGGCTGGACGG
CAAGTCCGTCTAGCTCACGGGCCCCTCCAGTGGAATGGGTCTTTTCGGTGGAGATAAAAG
TTGATTTGCTCTAACCGCAA
```

FIGURE 116

MAACEGRRSGALGSSQSDFLTPPVGGAPWAVATTVVMYPPPPPPPHRDFISVTLSFGESY
DNSKSWRRRSCWRKWKQLSRLQRNMILFLLAFLLFCGLLFYINLADHWKALAFRLEEEQK
MRPEIAGLKPANPPVLPAPQKADTDPENLPEISSQKTQRHIQRGPPHLQIRPPSQDLKDG
TQEEATKRQEAPVDPRPEGDPQRTVISWRGAVIEPEQGTELPSRRAEVPTKPPLPPARTQ
GTPVHLNYRQKGVIDVFLHAWKGYRKFAWGHDELKPVSRSFSEWFGLGLTLIDALDTMWI
LGLRKEFEEARKWVSKKLHFEKDVDVNLFESTIRILGGLLSAYHLSGDSLFLRKAEDFGN
RLMPAFRTPSKIPYSDVNIGTGVAHPPRWTSDSTVAEVTSIQLEFRELSRLTGDKKFQEA
VEKVTQHIHGLSGKKDGLVPMFINTHSGLFTHLGVFTLGARADSYYEYLLKQWIQGGKQE
TQLLEDYVEAIEGVRTHLLRHSEPSKLTFVGELAHGRFSAKMDHLVCFLPGTLALGVYHG
LPASHMELAQELMETCYQMNRQMETGLSPEIVHFNLYPQPGRRDVEVKPADRHNLLRPET
VESLFYLYRVTGDRKYQDWGWEILQSFSRFTRVPSGGYSSINNVQDPQKPEPRDKMESFF
LGETLKYLFLLFSDDPNLLSLDAYVFNTEAHPLPIWTPA

Important features of the protein:
Transmembrane domain:
amino acids 21-40 and 84-105 (type II)

FIGURE 117

```
GTGGGATTTATTTGAGTGCAAGATCGTTTTCTCAGTGGTGGTGGAAGTTGCCTCATCGCA
GGCAGATGTTGGGGCTTTGTCCGAACAGCTCCCCTCTGCCAGCTTCTGTAGATAAGGGTT
AAAAACTAATATTTATATGACAGAAGAAAAAGATGTCATTCCGTAAAGTAAACATCATCA
TCTTGGTCCTGGCTGTTGCTCTCTTCTTACTGGTTTTGCACCATAACTTCCTCAGCTTGA
GCAGTTTGTTAAGGAATGAGGTTACAGATTCAGGAATTGTAGGGCCTCAACCTATAGACT
TTGTCCCAAATGCTCTCCGACATGCAGTAGATGGGAGACAAGAGGAGATTCCTGTGGTCA
TCGCTGCATCTGAAGACAGGCTTGGGGGGCCATTGCAGCTATAAACAGCATTCAGCACA
ACACTCGCTCCAATGTGATTTTCTACATTGTTACTCTCAACAATACAGCAGACCATCTCC
GGTCCTGGCTCAACAGTGATTCCCTGAAAAGCATCAGATACAAAATTGTCAATTTTGACC
CTAAACTTTTGGAAGGAAAAGTAAAGGAGGATCCTGACCAGGGGGAATCCATGAAACCTT
TAACCTTTGCAAGGTTCTACTTGCCAATTCTGGTTCCCAGCGCAAAGAAGGCCATATACA
TGGATGATGATGTAATTGTGCAAGGTGATATTCTTGCCCTTTACAATACAGCACTGAAGC
CAGGACATGCAGCTGCATTTTCAGAAGATTGTGATTCAGCCTCTACTAAAGTTGTCATCC
GTGGAGCAGGAAACCAGTACAATTACATTGGCTATCTTGACTATAAAAGGAAAGAATTC
GTAAGCTTTCCATGAAAGCCAGCACTTGCTCATTTAATCCTGGAGTTTTTGTTGCAAACC
TGACGGAATGGAAACGACAGAATATAACTAACCAACTGGAAAATGGATGAAACTCAATG
TAGAAGAGGGACTGTATAGCAGAACCCTGGCTGGTAGCATCACAACACCTCCTCTGCTTA
TCGTATTTTATCAACAGCACTCTACCATCGATCCTATGTGGAATGTCCGCCACCTTGGTT
CCAGTGCTGGAAAACGATATTCACCTCAGTTTGTAAAGGCTGCCAAGTTACTCCATTGGA
ATGGACATTTGAAGCCATGGGGAAGGACTGCTTCATATACTGATGTTTGGGAAAATGGT
ATATTCCAGACCCAACAGGCAAATTCAACCTAATCCGAAGATATACCGAGATCTCAAACA
TAAAGTGAAACAGAATTTGAACTGTAAGCAAGCATTTCTCAGGAAGTCCTGGAAGATAGC
ATGCATGGGAAGTAACAGTTGCTAGGCTTCAATGCCTATCGGTAGCAAGCCATGGAAAAA
GATGTGTCAGCTAGGTAAAGATGACAAACTGCCCTGTCTGGCAGTCAGCTTCCCAGACAG
ACTATAGACTATAAATATGTCTCCATCTGCCTTACCAAGTGTTTTCTTACTACAATGCTG
AATGACTGGAAAGAAGAACTGATATGGCTAGTTCAGCTAGCTGGTACAGATAATTCAAAA
CTGCTGTTGGTTTTAATTTTGTAACCTGTGGCCTGATCTGTAAATAAAACTTACATTTTTC
```

FIGURE 118

```
MSFRKVNIIILVLAVALFLLVLHHNFLSLSSLLRNEVTDSGIVGPQPIDFVPNALRHAVD
GRQEEIPVVIAASEDRLGGAIAAINSIQHNTRSNVIFYIVTLNNTADHLRSWLNSDSLKS
IRYKIVNFDPKLLEGKVKEDPDQGESMKPLTFARFYLPILVPSAKKAIYMDDDVIVQGDI
LALYNTALKPGHAAAFSEDCDSASTKVVIRGAGNQYNYIGYLDYKKERIRKLSMKASTCS
FNPGVFVANLTEWKRQNITNQLEKWMKLNVEEGLYSRTLAGSITTPPLLIVFYQQHSTID
PMWNVRHLGSSAGKRYSPQFVKAAKLLHWNGHLKPWGRTASYTDVWEKWYIPDPTGKFNL
IRRYTEISNIK
```

FIGURE 119

CCATCCCTGAGATCTTTTTATAAAAAACCCAGTCTTTGCTGACCAGACAAAGCATACCAG
ATCTCACCAGAGAGTCGCAGACACTATGCTGCCTCCCATGGCCCTGCCCAGTGTGTCCTG
GATGCTGCTTTCCTGCCTCATTCTCCTGTGTCAGGTTCAAGGTGAAGAAACCCAGAAGGA
ACTGCCCTCTCCACGGATCAGCTGTCCCAAAGGCTCCAAGGCCTATGGCTCCCCTGCTA
TGCCTTGTTTTTGTCACCAAAATCCTGGATGGATGCAGATCTGGCTTGCCAGAAGCGGCC
CTCTGGAAAACTGGTGTCTGTGCTCAGTGGGGCTGAGGGATCCTTCGTGTCCTCCCTGGT
GAGGAGCATTAGTAACAGCTACTCATACATCTGGATTGGGCTCCATGACCCCACACAGGG
CTCTGAGCCTGATGGAGATGGATGGGAGTGGAGTAGCACTGATGTGATGAATTACTTTGC
ATGGGAGAAAAATCCCTCCACCATCTTAAACCCTGGCCACTGTGGGAGCCTGTCAAGAAG
CACAGGATTTCTGAAGTGGAAAGATTATAACTGTGATGCAAAGTTACCCTATGTCTGCAA
GTTCAAGGACTAGGGCAGGTGGGAAGTCAGCAGCCTCAGCTTGGCGTGCAGCTCATCATG
GACATGAGACCAGTGTGAAGACTCACCCTGGAAGAGAATATTCTCCCCAAACTGCCCTAC
CTGACTACCTTGTCATGATCCTCCTTCTTTTTCCTTTTTCTTCACCTTCATTTCAGGCTT
TTCTCTGTCTTCCATGTCTTGAGATCTCAGAGAATAATAATAAAAATGTTACTTTATAAA
AAAAAAAAAAAAAAAAAA

FIGURE 120

MLPPMALPSVSWMLLSCLILLCQVQGEETQKELPSPRISCPKGSKAYGSPCYALFLSPKS
WMDADLACQKRPSGKLVSVLSGAEGSFVSSLVRSISNSYSYIWIGLHDPTQGSEPDGDGW
EWSSTDVMNYFAWEKNPSTILNPGHCGSLSRSTGFLKWKDYNCDAKLPYVCKFKD

Important features:
Signal peptide:
amino acids 1-26

C-type lectin domain signature:
amino acids 146-171

FIGURE 121

AAAGTTACATTTTCTCTGGAACTCTCCTAGGCCACTCCCTGCTGATGCAACATCTGGGTT
TGGGCAGAAAGGAGGGTGCTTCGGAGCCCGCCCTTTCTGAGCTTCCTGGGCCGGCTCTAG
AACAATTCAGGCTTCGCTGCGACTCAGACCTCAGCTCCAACATATGCATTCTGAAGAAAG
ATGGCTGAGATGGACAGAATGCTTTATTTTGGAAAGAAACAATGTTCTAGGTCAAACTGA
GTCTACCAAATGCAGACTTTCACAATGGTTCTAGAAGAAATCTGGACAAGTCTTTTCATG
TGGTTTTTCTACGCATTGATTCCATGTTTGCTCACAGATGAAGTGGCCATTCTGCCTGCC
CCTCAGAACCTCTCTGTACTCTCAACCAACATGAAGCATCTCTTGATGTGGAGCCCAGTG
ATCGCGCCTGGAGAAACAGTGTACTATTCTGTCGAATACCAGGGGAGTACGAGAGCCTG
TACACGAGCCACATCTGGATCCCCAGCAGCTGGTGCTCACTCACTGAAGGTCCTGAGTGT
GATGTCACTGATGACATCACGGCCACTGTGCCATACAACCTTCGTGTCAGGGCCACATTG
GGCTCACAGACCTCAGCCTGGAGCATCCTGAAGCATCCCTTTAATAGAAACTCAACCATC
CTTACCCGACCTGGGATGGAGATCACCAAAGATGGCTTCCACCTGGTTATTGAGCTGGAG
GACCTGGGGCCCCAGTTTGAGTTCCTTGTGGCCTACTGGAGGAGGGAGCCTGGTGCCGAG
GAACATGTCAAATGGTGAGGAGTGGGGGTATTCCAGTGCACCTAGAAACCATGGAGCCA
GGGGCTGCATACTGTGTGAAGGCCCAGACATTCGTGAAGGCCATTGGGAGGTACAGCGCC
TTCAGCCAGACAGAATGTGTGGAGGTGCAAGGAGAGGCCATTCCCTGGTACTGGCCCTG
TTTGCCTTTGTTGGCTTCATGCTGATCCTTGTGGTCGTGCCACTGTTCGTCTGGAAAATG
GGCCGGCTGCTCCAGTACTCCTGTTGCCCCGTGGTGGTCCTCCAGACACCTTGAAAATA
ACCAATTCACCCCAGAAGTTAATCAGCTGCAGAAGGGAGGAGGTGGATGCCTGTGCCACG
GCTGTGATGTCTCCTGAGGAACTCCTCAGGGCCTGGATCTCATAGGTTTGCGGAAGGGCC
CAGGTGAAGCCGAGAACCTGGTCTGCATGACATGGAAACCATGAGGGGACAAGTTGTGTT
TCTGTTTTCCGCCACGGACAAGGGATGAGAGAAGTAGGAAGAGCCTGTTGTCTACAAGTC
TAGAAGCAACCATCAGAGGCAGGGTGGTTTGTCTAACAGAACACTGACTGAGGCTTAGGG
GATGTGACCTCTAGACTGGGGCTGCCACTTGCTGGCTGAGCAACCCTGGGAAAAGTGAC
TTCATCCCTTCGGTCCTAAGTTTTCTCATCTGTAATGGGGAATTACCTACACACCTGCT
AAACACACACACAGAGTCTCTCTCTATATACACACGTACACATAAATACACCCAGC
ACTTGCAAGGCTAGAGGGAAACTGGTGACACTCTACAGTCTGACTGATTCAGTGTTTCTG
GAGAGCAGGACATAAATGTATGATGAGAATGATCAAGGACTCTACACACTGGGTGGCTTG
GAGAGCCCACTTTCCCAGAATAATCCTTGAGAGAAAAGGAATCATGGGAGCAATGGTGTT
GAGTTCACTTCAAGCCCAATGCCGGTGCAGAGGGGAATGGCTTAGCGAGCTCTACAGTAG
GTGACCTGGAGGAAGGTCACAGCCACACTGAAAATGGATGTGCATGAACACGGAGGATC
CATGAACTACTGTAAAGTGTTGACAGTGTGTGCACACTGCAGACAGCAGGTGAAATGTAT
GTGTGCAATGCGACGAGAATGCAGAAGTCAGTAACATGTGCATGTTTGTTGCTCCTTT
TTTCTGTTGGTAAAGTACAGAATTCAGCAAATAAAAGGGCCACCCTGGCCAAAAGCGGT
AAAAAAAAAAAAAAAA

FIGURE 122

MQTFTMVLEEIWTSLFMWFFYALIPCLLTDEVAILPAPQNLSVLSTNMKHLLMWSPVIAP
GETVYYSVEYQGEYESLYTSHIWIPSSWCSLTEGPECDVTDDITATVPYNLRVRATLGSQ
TSAWSILKHPFNRNSTILTRPGMEITKDGFHLVIELEDLGPQFEFLVAYWRREPGAEEHV
KMVRSGGIPVHLETMEPGAAYCVKAQTFVKAIGRYSAFSQTECVEVQGEAIPLVLALFAF
VGFMLILVVVPLFVWKMGRLLQYSCCPVVVLPDTLKITNSPQKLISCRREEVDACATAVM
SPEELLRAWIS

Important features:
Signal peptide:
amino acids 1-29

Transmembrane domain:
amino acids 230-255

N-glycosylation sites:
amino acids 40-43 and 134-137

Tissue factor proteins homology:
amino acids 92-119

Integrins alpha chain protein homology:
amino acids 232-262

FIGURE 123

```
CGGACGCGTGGGCCGCCACCTCCGGAACAAGCCATGGTGGCGGCGACGGTGGCAGCGGCG
TGGCTGCTCCTGTGGGCTGCGGCCTGCGCGCAGCAGGAGCAGGACTTCTACGACTTCAAG
GCGGTCAACATCCGGGGCAAACTGGTGTCGCTGGAGAAGTACCGCGGATCGGTGTCCCTG
GTGGTGAATGTGGCCAGCGAGTGCGGCTTCACAGACCAGCACTACCGAGCCCTGCAGCAG
CTGCAGCGAGACCTGGGCCCCACCACTTTAACGTGCTCGCCTTCCCCTGCAACCAGTTT
GGCCAACAGGAGCCTGACAGCAACAAGGAGATTGAGAGCTTTGCCCGCCGCACCTACAGT
GTCTCATTCCCCATGTTTAGCAAGATTGCAGTCACCGGTACTGGTGCCCATCCTGCCTTC
AAGTACCTGGCCCAGACTTCTGGGAAGGAGCCCACCTGGAACTTCTGGAAGTACCTAGTA
GCCCCAGATGGAAAGGTGGTAGGGCTTGGGACCCAACTGTGTCAGTGGAGGAGGTCAGA
CCCCAGATCACAGCGCTCGTGAGGAAGCTCATCCTACTGAAGCGAGAAGACTTATAACCA
CCGCGTCTCCTCCTCCACCACCTCATCCCGCCCACCTGTGTGGGGCTGACCAATGCAAAC
TCAAATGGTGCTTCAAAGGGAGAGACCCACTGACTCTCCTTCCTTTACTCTTATGCCATT
GGTCCCATCATTCTTGTGGGGAAAAATTCTAGTATTTTGATTATTTGAATCTTACAGCA
ACAAATAGGAACTCCTGGCCAATGAGAGCTCTTGACCAGTGAATCACCAGCCGATACGAA
CGTCTTGCCAACAAAATGTGTGGCAAATAGAAGTATATCAAGCAATAATCTCCCACCCA
AGGCTTCTGTAAACTGGGACCAATGATTACCTCATAGGGCTGTTGTGAGGATTAGGATGA
ATACCTGTGAAAGTGCCTAGGCAGTGCCAGCCAAATAGGAGGCATTCAATGAACATTTT
TTGCATATAAACCAAAAAATAACTTGTTATCAATAAAAACTTGCATCCAACATGAATTTC
CAGCCGATGATAATCCAGGCCAAAGGTTTAGTTGTTGTTATTTCCTCTGTATTATTTTCT
TCATTACAAAAGAAATGCAAGTTCATTGTAACAATCCAAACAATACCTCACGATATAAAA
TAAAAATGAAAGTATCCTCCTCAAAAA
```

FIGURE 124

MVAATVAAAWLLLWAAACAQQEQDFYDFKAVNIRGKLVSLEKYRGSVSLVVNVASECGFT
DQHYRALQQLQRDLGPHHFNVLAFPCNQFGQQEPDSNKEIESFARRTYSVSFPMFSKIAV
TGTGAHPAFKYLAQTSGKEPTWNFWKYLVAPDGKVVGAWDPTVSVEEVRPQITALVRKLI
LLKREDL

FIGURE 125

```
CGGACGCGTGGGCGGACGCGTGGGCGGACGCGTGGGTTGGGAGGGGGCAGGATGGGAGGG
AAAGTGAAGAAAACAGAAAAGGAGAGGGACAGAGGCCAGAGGACTTCTCATACTGGACAG
AAACCGATCAGGCATGGAACTCCCCTTCGTCACTCACCTGTTCTTGCCCCTGGTGTTCCT
GACAGGTCTCTGCTCCCCCTTTAACCTGGATGAACATCACCCACGCCTATTCCCAGGGCC
ACCAGAAGCTGAATTTGGATACAGTGTCTTACAACATGTTGGGGGTGGACAGCGATGGAT
GCTGGTGGGCGCCCCTGGGATGGGCCTTCAGGCGACCGGAGGGGGGACGTTTATCGCTG
CCCTGTAGGGGGGGCCCACAATGCCCCATGTGCCAAGGGCCACTTAGGTGACTACCAACT
GGGAAATTCATCTCATCCTGCTGTGAATATGCACCTGGGGATGTCTCTGTTAGAGACAGA
TGGTGATGGGGGATTCATGGTGAGCTAAGGAGAGGGTGGTGGCAGTGTCTCTGAAGGTCC
ATAAAGAAAAAGAGAAGTGTGGTAAGGGAAAATGGTCTGTGTGGAGGGGTCAAGGAGT
TAAAAACCCTAGAAAGCAAAAGGTAGGTAATGTCAGGGAGTAGTCTTCATGCCTCCTTCA
ACTGGGAGCATGTTCTGAGGGTGCCCTCCCAAGCCTGGGAGTAACTATTTCCCCCATCCC
CAGGCCTGTGCCCCTCTCTGGTCTCGTGCTTGTGGCAGCTCTGTCTTCAGTTCTGGGATA
TGTGCCCGTGTGGATGCTTCATTCCAGCCTCAGGGAAGCCTGGCACCCACTGCCCAACGT
GAGCCAGAGGAAGGCTGAGTACTTGGTTCCCAGAAGGAGATACTGGGTGGGAAAAAGATG
GGGCAAAGCGGTATGATGCCTGGCAAAGGGCCTGCATGGCTATCCTCATTGCTACCTAAT
GTGCTTGCAAAAGCTCCATGTTTCCTAACAGATTCAGACTCCTGGCCAGGTGTGGTGGCC
CACACCTGTAATTCTAGCACTTTGGGAGGCCAAGGTGGGCAGATCACTTGAGGTCAGGAG
TTCAAGACCAGCCTGGCCAACATGGTGAAACTCCATCTCTACTAAAAAAAAAAAAATACA
AAAATTAGCTGGGTGCGCTAGTGCATGCCTGTAATCTCATCTACTCGGGAGGCTAAGACA
GGAGACTCTCACTTCAACCCAGGAGGTGGAGGTTGCGGTGAGCCAAGATTGTGCCTCTGC
ACTCTAGCGTGGGTGACAGAGTAAGCGAGACTCCATCTCAAAAATAATAATAATAATAAT
TCAGACTCCTTATCAGGAGTCCATGATCTGGCCTGGCACAGTAACTCATGCCTGTAATCC
CAACATTTTGGGAGGCCAACGCAGGAGGATTGCTTGAGGTCTGGAGGTTTGAGACCAGCC
TGGGCAACATAGAAAGACCCCATCTCTAAATAAATGTTTTAAAAAT
```

FIGURE 126

MELPFVTHLFLPLVFLTGLCSPFNLDEHHPRLFPGPPEAEFGYSVLQHVGGGQRWMLVGA
PWDGPSGDRRGDVYRCPVGGAHNAPCAKGHLGDYQLGNSSHPAVNMHLGMSLLETDGDGG
FMVS

Important features:
Signal peptide:
amino acids 1-22

Cell attachment sequence:
amino acids 70-73

N-glycosylation site:
amino acids 98-101

Integrins alpha chain proteins:
amino acids 67-81

FIGURE 127

```
GAGAGGACGAGGTGCCGCTGCCTGGAGAATCCTCCGCTGCCGTCGGCTCCCGGAGCCCAG
CCCTTTCCTAACCCAACCCAACCTAGCCCAGTCCCAGCCGCCAGCGCCTGTCCCTGTCAC
GGACCCCAGCGTTACCATGCATCCTGCCGTCTTCCTATCCTTACCCGACCTCAGATGCTC
CCTTCTGCTCCTGGTAACTTGGGTTTTTACTCCTGTAACAACTGAAATAACAAGTCTTGC
TACAGAGAATATAGATGAAATTTTAAACAATGCTGATGTTGCTTTAGTAAATTTTTATGC
TGACTGGTGTCGTTTCAGTCAGATGTTGCATCCAATTTTTGAGGAAGCTTCCGATGTCAT
TAAGGAAGAATTTCCAAATGAAAATCAAGTAGTGTTTGCCAGAGTTGATTGTGATCAGCA
CTCTGACATAGCCCAGAGATACAGGATAAGCAAATACCCAACCCTCAAATTGTTTCGTAA
TGGGATGATGATGAAGAGAGAATACAGGGGTCAGCGATCAGTGAAAGCATTGGCAGATTA
CATCAGGCAACAAAAAAGTGACCCCATTCAAGAAATTCGGGACTTAGCAGAAATCACCAC
TCTTGATCGCAGCAAAAGAAATATCATTGGATATTTTGAGCAAAAGGACTCGGACAACTA
TAGAGTTTTTGAACGAGTAGCGAATATTTTGCATGATGACTGTGCCTTTCTTTCTGCATT
TGGGGATGTTTCAAAACCGGAAAGATATAGTGGCGACAACATAATCTACAAACCACCAGG
GCATTCTGCTCCGGATATGGTGTACTTGGGAGCTATGACAAATTTTGATGTGACTTACAA
TTGGATTCAAGATAAATGTGTTCCTCTTGTCCGAGAAATAACATTTGAAAATGGAGAGGA
ATTGACAGAAGAAGGACTGCCTTTTCTCATACTCTTTCACATGAAAGAAGATACAGAAAG
TTTAGAAATATTCCAGAATGAAGTAGCTCGGCAATTAATAAGTGAAAAGGTACAATAAA
CTTTTTACATGCCGATTGTGACAAATTTAGACATCCTCTTCTGCACATACAGAAAACTCC
AGCAGATTGTCCTGTAATCGCTATTGACAGCTTTAGGCATATGTATGTGTTTGGAGACTT
CAAAGATGTATTAATTCCTGGAAAACTCAAGCAATTCGTATTTGACTTACATTCTGGAAA
ACTGCACAGAGAATTCCATCATGGACCTGACCCAACTGATACAGCCCCAGGAGAGCAAGC
CCAAGATGTAGCAAGCAGTCCACCTGAGAGCTCCTTCCAGAAACTAGCACCCAGTGAATA
TAGGTATACTCTATTGAGGGATCGAGATGAGCTTTAAAAACTTGAAAAACAGTTTGTAAG
CCTTTCAACAGCAGCATCAACCTACGTGGTGGAAATAGTAAACCTATATTTTCATAATTC
TATGTGTATTTTTATTTTGAATAAACAGAAAGAAATTTAAAAAAAAAAAAAAAAAAAAA
AAAAAAAAAAAAAAAAAAAAAA
```

FIGURE 128

MHPAVFLSLPDLRCSLLLLVTWVFTPVTTEITSLATENIDEILNNADVALVNFYADWCRF
SQMLHPIFEEASDVIKEEFPNENQVVFARVDCDQHSDIAQRYRISKYPTLKLFRNGMMMK
REYRGQRSVKALADYIRQQKSDPIQEIRDLAEITTLDRSKRNIIGYFEQKDSDNYRVFER
VANILHDDCAFLSAFGDVSKPERYSGDNIIYKPPGHSAPDMVYLGAMTNFDVTYNWIQDK
CVPLVREITFENGEELTEEGLPFLILFHMKEDTESLEIFQNEVARQLISEKGTINFLHAD
CDKFRHPLLHIQKTPADCPVIAIDSFRHMYVFGDFKDVLIPGKLKQFVFDLHSGKLHREF
HHGPDPTDTAPGEQAQDVASSPPESSFQKLAPSEYRYTLLRDRDEL

Important features:
Signal peptide:
amino acids 1-29

Endoplasmic reticulum targeting sequence:
amino acids 403-406

Tyrosine kinase phosphorylation site:
amino acids 203-211

Thioredoxin family proteins:
amino acids 50-66

FIGURE 129

```
GAGCAGGACGGAGCCATGGACCCCGCCAGGAAAGCAGGTGCCCAGGCCATGATCTGGACT
GCAGGCTGGCTGCTGCTGCTGCTGCTTCGCGGAGGAGCGCAGGCCCTGGAGTGCTACAGC
TGCGTGCAGAAAGCAGATGACGGATGCTCCCCGAACAAGATGAAGACAGTGAAGTGCGCG
CCGGGCGTGGACGTCTGCACCGAGGCCGTGGGGGCGGTGGAGACCATCCACGGACAATTC
TCGCTGGCAGTGCGGGGTTGCGGTTCGGGACTCCCCGGCAAGAATGACCGCGGCCTGGAT
CTTCACGGGCTTCTGGCGTTCATCCAGCTGCAGCAATGCGCTCAGGATCGCTGCAACGCC
AAGCTCAACCTCACCTCGCGGGCGCTCGACCCGGCAGGTAATGAGAGTGCATACCCGCCC
AACGGCGTGGAGTGCTACAGCTGTGTGGGCCTGAGCCGGGAGGCGTGCCAGGGTACATCG
CCGCCGGTCGTGAGCTGCTACAACGCCAGCGATCATGTCTACAAGGGCTGCTTCGACGGC
AACGTCACCTTGACGGCAGCTAATGTGACTGTGTCCTTGCCTGTCCGGGCTGTGTCCAG
GATGAATTCTGCACTCGGGATGGAGTAACAGGCCCAGGGTTCACGCTCAGTGGCTCCTGT
TGCCAGGGGTCCCGCTGTAACTCTGACCTCCGCAACAAGACCTACTTCTCCCCTCGAATC
CCACCCCTTGTCCGGCTGCCCCCTCCAGAGCCCACGACTGTGGCCTCAACCACATCTGTC
ACCACTTCTACCTCGGCCCCAGTGAGACCCACATCCACCACCAAACCCATGCCAGCGCCA
ACCAGTCAGACTCCGAGACAGGGAGTAGAACACGAGGCCTCCCGGGATGAGGAGCCCAGG
TTGACTGGAGGCGCCGCTGGCCACCAGGACCGCAGCAATTCAGGGCAGTATCCTGCAAAA
GGGGGGCCCCAGCAGCCCCATAATAAAGGCTGTGTGGCTCCCACAGCTGGATTGGCAGCC
CTTCTGTTGGCCGTGGCTGCTGGTGTCCTACTGTGAGCTTCTCCACCTGGAAATTTCCCT
CTCACCTACTTCTCTGGCCCTGGGTACCCCTCTTCTCATCACTTCCTGTTCCCACCACTG
GACTGGGCTGGCCCAGCCCCTGTTTTTCCAACATTCCCCAGTATCCCCAGCTTCTGCTGC
GCTGGTTTGCGGCTTTGGGAAATAAAATACCGTTGTATATATTCTGCCAGGGGTGTTCTA
GCTTTTTGAGGACAGCTCCTGTATCCTTCTCATCCTTGTCTCTCCGCTTGTCCTCTTGTG
ATGTTAGGACAGAGTGAGAGAAGTCAGCTGTCACGGGGAAGGTGAGAGAGAGGATGCTAA
GCTTCCTACTCACTTTCTCCTAGCCAGCCTGGACTTTGGAGCGTGGGGTGGGTGGGACAA
TGGCTCCCCACTCTAAGCACTGCCTCCCCTACTCCCCGCATCTTTGGGGAATCGGTTCCC
CATATGTCTTCCTTACTAGACTGTGAGCTCCTCGGGGGGGCCCGGTACCCAATTCGCC
CTATAGTGAGTCGTA
```

FIGURE 130

```
MDPARKAGAQAMIWTAGWLLLLLLRGGAQALECYSCVQKADDGCSPNKMKTVKCAPGVDV
CTEAVGAVETIHGQFSLAVRGCGSGLPGKNDRGLDLHGLLAFIQLQQCAQDRCNAKLNLT
SRALDPAGNESAYPPNGVECYSCVGLSREACQGTSPPVVSCYNASDHVYKGCFDGNVTLT
AANVTVSLPVRGCVQDEFCTRDGVTGPGFTLSGSCCQGSRCNSDLRNKTYFSPRIPPLVR
LPPPEPTTVASTTSVTTSTSAPVRPTSTTKPMPAPTSQTPRQGVEHEASRDEEPRLTGGA
AGHQDRSNSGQYPAKGGPQQPHNKGCVAPTAGLAALLLAVAAGVLL
```

FIGURE 131

AAACTTGACGCCATGAAGATCCCGGTCCTTCCTGCCGTGGTGCTCCTCTCCCTCCTGGTG
CTCCACTCTGCCCAGGGAGCCACCCTGGGTGGTCCTGAGGAAGAAAGCACCATTGAGAAT
TATGCGTCACGACCCGAGGCCTTTAACACCCCGTTCCTGAACATCGACAAATTGCGATCT
GCGTTTAAGGCTGATGAGTTCCTGAACTGGCACGCCCTCTTTGAGTCTATCAAAAGGAAA
CTTCCTTTCCTCAACTGGGATGCCTTTCCTAAGCTGAAAGGACTGAGGAGCGCAACTCCT
GATGCCCAGTGACCATGACCTCCACTGGAAGAGGGGGCTAGCGTGAGCGCTGATTCTCAA
CCTACCATAACTCTTTCCTGCCTCAGGAACTCCAATAAACATTTTCCATCCAAA

FIGURE 132

MKIPVLPAVVLLSLLVLHSAQGATLGGPEEESTIENYASRPEAFNTPFLNIDKLRSAFKA
DEFLNWHALFESIKRKLPFLNWDAFPKLKGLRSATPDAQ

FIGURE 133

CAGTTCTGAAATCAATGGAGTTAATTTAGGGAATACAAACCAGCCATGGGGGTGGAGATT
GCCTTTGCCTCAGTGATTCTCACCTGCCTCTCCCTTCTGGCAGCAGGAGTCTCCCAGGTT
GTTCTTCTCCAGCCAGTTCCAACTCAGGAGACAGGTCCCAAGGCCATGGGAGATCTCTCC
TGTGGCTTTGCCGGCCACTCATGAGAGTGTTTTTGTGTAAAGTATTTTTTAGAATACTGT
TGACTTCTTCATGATTTAATAACCATCCTTTGCGAAGTTTTATGAGGCTTTAGGGGAATG
TCAACCCTCAAATTTTTGTTATACTAGATGGCTTCCATTTACCCACCACTATTTTAAGGT
CCCTTTATTTTTAGGTTCAAGGTTCATTTGACTTGAGAAAGTGCCCTTCTGCAGCTTCAT
TGATTTTGTTTATCTTCACTATTAATTGTAACGATTAAAAAAGAATAAGAGCACGCAGAC
CTCTAGGAGAATATTTTATCCCTGGGTGCCCCTGACACATTTATGTAGTGATCCCACAAA
TGTGATTGTTAATTTAAATGTTATTCTAATATTAGTACATTCAGTTGTGATGTAATATGA
ATAACCAGAATCTATTTCTTAAAAGTTTTGAGTATATTTTTCAACTAGATATTTGTATAG
AAAGACTGAATAGTGATG

FIGURE 134

MGVEIAFASVILTCLSLLAAGVSQVVLLQPVPTQETGPKAMGDLSCGFAGHS

FIGURE 135

```
GGGGAATCTGCAGTAGGTCTGCCGGCGATGGAGTGGTGGGCTAGCTCGCCGCTTCGGCTC
TGGCTGCTGTTGTTCCTCCTGCCCTCAGCGCAGGGCCGCCAGAAGGAGTCAGGTTCAAAA
TGGAAAGTATTTATTGACCAAATTAACAGGTCTTTGGAGAATTACGAACCATGTTCAAGT
CAAAACTGCAGCTGCTACCATGGTGTCATAGAAGAGGATCTAACTCCTTTCCGAGGAGGC
ATCTCCAGGAAGATGATGGCAGAGGTAGTCAGACGGAAGCTAGGGACCCACTATCAGATC
ACTAAGAACAGACTGTACCGGGAAAATGACTGCATGTTCCCCTCAAGGTGTAGTGGTGTT
GAGCACTTTATTTTGGAAGTGATCGGGCGTCTCCCTGACATGGAGATGGTGATCAATGTA
CGAGATTATCCTCAGGTTCCTAAATGGATGGAGCCTGCCATCCCAGTCTTCTCCTTCAGT
AAGACATCAGAGTACCATGATATCATGTATCCTGCTTGGACATTTTGGGAAGGGGGACCT
GCTGTTTGGCCAATTTATCCTACAGGTCTTGGACGGTGGGACCTCTTCAGAGAAGATCTG
GTAAGGTCAGCAGCACAGTGGCCATGGAAAAGAAAAACTCTACAGCATATTTCCGAGGA
TCAAGGACAAGTCCAGAACGAGATCCTCTCATTCTTCTGTCTCGGAAAAACCCAAAACTT
GTTGATGCAGAATACACCAAAAACCAGGCCTGGAAATCTATGAAAGATACCTTAGGAAAG
CCAGCTGCTAAGGATGTCCATCTTGTGGATCACTGCAAATACAAGTATCTGTTTAATTTT
CGAGGCGTAGCTGCAAGTTTCCGGTTTAAACACCTCTTCCTGTGTGGCTCACTTGTTTTC
CATGTTGGTGATGAGTGGCTAGAATTCTTCTATCCACAGCTGAAGCCATGGGTTCACTAT
ATCCCAGTCAAAACAGATCTCTCCAATGTCCAAGAGCTGTTACAATTTGTAAAAGCAAAT
GATGATGTAGCTCAAGAGATTGCTGAAAGGGGAAGCCAGTTTATTAGGAACCATTTGCAG
ATGGATGACATCACCTGTTACTGGGAGAACCTCTTGAGTGAATACTCTAAATTCCTGTCT
TATAATGTAACGAGAAGGAAAGGTTATGATCAAATTATTCCCAAAATGTTGAAAACTGAA
CTATAGTAGTCATCATAGGACCATAGTCCTCTTTGTGGCAACAGATCTCAGATATCCTAC
GGTGAGAAGCTTACCATAAGCTTGGCTCCTATACCTTGAATATCTGCTATCAAGCCAAAT
ACCTGGTTTTCCTTATCATGCTGCACCCAGAGCAACTCTTGAGAAAGATTTAAAATGTGT
CTAATACACTGATATGAAGCAGTTCAACTTTTTGGATGAATAAGGACCAGAAATCGTGAG
ATGTGGATTTTGAACCCAACTCTACCTTTCATTTTCTTAAGACCAATCACAGCTTGTGCC
TCAGATCATCCACCTGTGTGAGTCCATCACTGTGAAATTGACTGTGTCCATGTGATGATG
CCCTTTGTCCCATTATTTGGAGCAGAAAATTCGTCATTTGGAAGTAGTACAACTCATTGC
TGGAATTGTGAAATTATTCAAGGCGTGATCTCTGTCACTTTATTTTAATGTAGGAAACCC
TATGGGGTTTATGAAAATACTTGGGGATCATTCTCTGAATGGTCTAAGGAAGCGGTAGC
CATGCCATGCAATGATGTAGGAGTTCTCTTTTGTAAAACCATAAACTCTGTTACTCAGGA
GGTTTCTATAATGCCACATAGAAAGAGGCCAATTGCATGAGTAATTATTGCAATTGGATT
TCAGGTTCCCTTTTTGTGCCTTCATGCCCTACTTCTTAATGCCTCTAAAGCCAAA
```

FIGURE 136

MEWWASSPLRLWLLLFLLPSAQGRQKESGSKWKVFIDQINRSLENYEPCSSQNCSCYHGV
IEEDLTPFRGGISRKMMAEVVRRKLGTHYQITKNRLYRENDCMFPSRCSGVEHFILEVIG
RLPDMEMVINVRDYPQVPKWMEPAIPVFSFSKTSEYHDIMYPAWTFWEGGPAVWPIYPTG
LGRWDLFREDLVRSAAQWPWKKKNSTAYFRGSRTSPERDPLILLSRKNPKLVDAEYTKNQ
AWKSMKDTLGKPAAKDVHLVDHCKYKYLFNFRGVAASFRFKHLFLCGSLVFHVGDEWLEF
FYPQLKPWVHYIPVKTDLSNVQELLQFVKANDDVAQEIAERGSQFIRNHLQMDDITCYWE
NLLSEYSKFLSYNVTRRKGYDQIIPKMLKTEL

FIGURE 137

ATTCTCCTAGAGCATCTTTGGAAGCATGAGGCCACGATGCTGCATCTTGGCTCTTGTCTG
CTGGATAACAGTCTTCCTCCTCCAGTGTTCAAAAGGAACTACAGACGCTCCTGTTGGCTC
AGGACTGTGGCTGTGCCAGCCGACACCCAGGTGTGGGAACAAGATCTACAACCCTTCAGA
GCAGTGCTGTTATGATGATGCCATCTTATCCTTAAAGGAGACCCGCCGCTGTGGCTCCAC
CTGCACCTTCTGGCCCTGCTTTGAGCTCTGCTGTCCCGAGTCTTTTGGCCCCAGCAGAA
GTTTCTTGTGAAGTTGAGGGTTCTGGGTATGAAGTCTCAGTGTCACTTATCTCCCATCTC
CCGGAGCTGTACCAGGAACAGGAGGCACGTCCTGTACCCATAAAAACCCCAGGCTCCACT
GGCAGACGGCAGACAAGGGGAGAAGAGACGAAGCAGCTGGACATCGGAGACTACAGTTGA
ACTTCGGAGAGAAGCAACTTGACTTCAGAGGGATGGCTCAATGACATAGCTTTGGAGAGG
AGCCCAGCTGGGGATGGCCAGACTTCAGGGGAAGAATGCCTTCCTGCTTCATCCCCTTTC
CAGCTCCCCTTCCCGCTGAGAGCCACTTTCATCGGCAATAAAATCCCCACATTTACCATCT

FIGURE 138

MRPRCCILALVCWITVFLLQCSKGTTDAPVGSGLWLCQPTPRCGNKIYNPSEQCCYDDAI
LSLKETRRCGSTCTFWPCFELCCPESFGPQQKFLVKLRVLGMKSQCHLSPISRSCTRNRR
HVLYP

Important features:
Signal sequence:
amino acids 1-21

N-myristoylation sites:
amino acids 33-39, 70-76

FIGURE 139

CCTCTGTCCACTGCTTTCGTGAAGACAAGATGAAGTTCACAATTGTCTTTGCTGGACTTC
TTGGAGTCTTTCTAGCTCCTGCCCTAGCTAACTATAATATCAACGTCAATGATGACAACA
ACAATGCTGGAAGTGGGCAGCAGTCAGTGAGTGTCAACAATGAACACAATGTGGCCAATG
TTGACAATAACAACGGATGGGACTCCTGGAATTCCATCTGGGATTATGGAAATGGCTTTG
CTGCAACCAGACTCTTTCAAAAGAAGACATGCATTGTGCACAAAATGAACAAGGAAGTCA
TGCCCTCCATTCAATCCCTTGATGCACTGGTCAAGGAAAAGAAGCTTCAGGGTAAGGGAC
CAGGAGGACCACCTCCCAAGGGCCTGATGTACTCAGTCAACCCAAACAAAGTCGATGACC
TGAGCAAGTTCGGAAAAAACATTGCAAACATGTGTCGTGGGATTCCAACATACATGGCTG
AGGAGATGCAAGAGGCAAGCCTGTTTTTTTACTCAGGAACGTGCTACACGACCAGTGTAC
TATGGATTGTGGACATTTCCTTCTGTGGAGACACGGTGGAGAACTAAACAATTTTTTAAA
GCCACTATGGATTTAGTCATCTGAATATGCTGTGCAGAAAAAATATGGGCTCCAGTGGTT
TTTACCATGTCATTCTGAAATTTTTCTCTACTAGTTATGTTTGATTTCTTTAAGTTTCAA
TAAAATCATTTAGCATTGAAAAAAA

FIGURE 140

MKFTIVFAGLLGVFLAPALANYNINVNDDNNNAGSGQQSVSVNNEHNVANVDNNNGWDSW
NSIWDYGNGFAATRLFQKKTCIVHKMNKEVMPSIQSLDALVKEKKLQGKGPGGPPPKGLM
YSVNPNKVDDLSKFGKNIANMCRGIPTYMAEEMQEASLFFYSGTCYTTSVLWIVDISFCG
DTVEN

Signal Peptide:
amino acids 1-20

N-myristoylation Sites:
amino acids 67-72, 118-123, 163-168

Flavodoxin protein homology:
amino acids 156-174

FIGURE 141

```
GGTCCTTAATGGCAGCAGCCGCCGCTACCAAGATCCTTCTGTGCCTCCCGCTTCTGCTCC
TGCTGTCCGGCTGGTCCCGGGCTGGGCGAGCCGACCCTCACTCTCTTTGCTATGACATCA
CCGTCATCCCTAAGTTCAGACCTGGACCACGGTGGTGTGCGGTTCAAGGCCAGGTGGATG
AAAAGACTTTTCTTCACTATGACTGTGGCAACAAGACAGTCACACCTGTCAGTCCCCTGG
GGAAGAAACTAAATGTCACAACGGCCTGGAAAGCACAGAACCCAGTACTGAGAGAGGTGG
TGGACATACTTACAGAGCAACTGCGTGACATTCAGCTGGAGAATTACACACCCAAGGAAC
CCCTCACCCTGCAGGCAAGGATGTCTTGTGAGCAGAAAGCTGAAGGACACAGCAGTGGAT
CTTGGCAGTTCAGTTTCGATGGGCAGATCTTCCTCCTCTTTGACTCAGAGAAGAGAATGT
GGACAACGGTTCATCCTGGAGCCAGAAAGATGAAAGAAAAGTGGGAGAATGACAAGGTTG
TGGCCATGTCCTTCCATTACTTCTCAATGGGAGACTGTATAGGATGGCTTGAGGACTTCT
TGATGGGCATGGACAGCACCCTGGAGCCAAGTGCAGGAGCACCACTCGCCATGTCCTCAG
GCACAACCCAACTCAGGGCCACAGCCACCACCCTCATCCTTTGCTGCCTCCTCATCATCC
TCCCCTGCTTCATCCTCCCTGGCATCTGAGGAGAGTCCTTTAGAGTGACAGGTTAAAGCT
GATACCAAAAGGCTCCTGTGAGCACGGTCTTGATCAAACTCGCCCTTCTGTCTGGCCAGC
TGCCCACGACCTACGGTGTATGTCCAGTGGCCTCCAGCAGATCATGATGACATCATGGAC
CCAATAGCTCATTCACTGCCTTGATTCCTTTTGCCAACAATTTTACCAGCAGTTATACCT
AACATATTATGCAATTTTCTCTTGGTGCTACCTGATGGAATTCCTGCACTTAAAGTTCTG
GCTGACTAAACAAGATATATCATTTTCTTTCTTCTCTTTTTGTTTGGAAAATCAAGTACT
TCTTTGAATGATGATCTCTTTCTTGCAAATGATATTGTCAGTAAAATAATCACGTTAGAC
TTCAGACCTCTGGGGATTCTTTCCGTGTCCTGAAAGAGAATTTTTAAATTATTTAATAAG
AAAAAATTTATATTAATGATTGTTTCCTTTAGTAATTTATTGTTCTGTACTGATATTTAA
ATAAAGAGTTCTATTTCCCAAAAAAAAAAAAAAAAAA
```

FIGURE 142

MAAAAATKILLCLPLLLLLSGWSRAGRADPHSLCYDITVIPKFRPGPRWCAVQGQVDEKT
FLHYDCGNKTVTPVSPLGKKLNVTTAWKAQNPVLREVVDILTEQLRDIQLENYTPKEPLT
LQARMSCEQKAEGHSSGSWQFSFDGQIFLLFDSEKRMWTTVHPGARKMKEKWENDKVVAM
SFHYFSMGDCIGWLEDFLMGMDSTLEPSAGAPLAMSSGTTQLRATATTLILCCLLIILPC
FILPGI

Important features:
Signal peptide:
amino acids 1-25

Transmembrane domain:
amino acids 224-246

N-glycosylation site:
amino acids 68-72, 82-86

N-myristoylation site:
amino acids 200-206, 210-216

Amidation site:
amino acids 77-81

FIGURE 143

AATGTGAGAGGGGCTGATGGAAGCTGATAGGCAGGACTGGAGTGTTAGCACCAGTACTGG
ATGTGACAGCAGGCAGAGGAGCACTTAGCAGCTTATTCAGTGTCCGATTCTGATTCCGGC
AAGGATCCAAGCATGGAATGCTGCCGTCGGGCAACTCCTGGCACACTGCTCCTCTTTCTG
GCTTTCCTGCTCCTGAGTTCCAGGACCGCACGCTCCGAGGAGGACCGGGACGGCCTATGG
GATGCCTGGGGCCCATGGAGTGAATGCTCACGCACCTGCGGGGAGGGGCCTCCTACTCT
CTGAGGCGCTGCCTGAGCAGCAAGAGCTGTGAAGGAAGAAATATCCGATACAGAACATGC
AGTAATGTGGACTGCCCACCAGAAGCAGGTGATTTCCGAGCTCAGCAATGCTCAGCTCAT
AATGATGTCAAGCACCATGGCCAGTTTTATGAATGGCTTCCTGTGTCTAATGACCCTGAC
AACCCATGTTCACTCAAGTGCCAAGCCAAAGGAACAACCCTGGTTGTTGAACTAGCACCT
AAGGTCTTAGATGGTACGCGTTGCTATACAGAATCTTTGGATATGTGCATCAGTGGTTTA
TGCCAAATTGTTGGCTGCGATCACCAGCTGGGAAGCACCGTCAAGGAAGATAACTGTGGG
GTCTGCAACGGAGATGGGTCCACCTGCCGGCTGGTCCGAGGGCAGTATAAATCCCAGCTC
TCCGCAACCAAATCGGATGATACTGTGGTTGCACTTCCCTATGGAAGTAGACATATTCGC
CTTGTCTTAAAAGGTCCTGATCACTTATATCTGGAAACCAAAACCCTCCAGGGGACTAAA
GGTGAAAACAGTCTCAGCTCCACAGGAACTTTCCTTGTGGACAATTCTAGTGTGGACTTC
CAGAAATTTCCAGACAAAGAGATACTGAGAATGGCTGGACCACTCACAGCAGATTTCATT
GTCAAGATTCGTAACTCGGGCTCCGCTGACAGTACAGTCCAGTTCATCTTCTATCAACCC
ATCATCCACCGATGGAGGGAGACGGATTTCTTTCCTTGCTCAGCAACCTGTGGAGGAGGT
TATCAGCTGACATCGGCTGAGTGCTACGATCTGAGGAGCAACCGTGTGGTTGCTGACCAA
TACTGTCACTATTACCCAGAGAACATCAAACCCAAACCCAAGCTTCAGGAGTGCAACTTG
GATCCTTGTCCAGCCAGTGACGGATACAAGCAGATCATGCCTTATGACCTCTACCATCCC
CTTCCTCGGTGGGAGGCCACCCCATGGACCGCGTGCTCCTCCTCGTGTGGGGGGGCATC
CAGAGCCGGGCAGTTTCCTGTGTGGAGGAGGACATCCAGGGGCATGTCACTTCAGTGGAA
GAGTGGAAATGCATGTACACCCCTAAGATGCCCATCGCGCAGCCCTGCAACATTTTTGAC
TGCCCTAAATGGCTGGCACAGGAGTGGTCTCCGTGCACAGTGACATGTGGCCAGGGCCTC
AGATACCGTGTGGTCCTCTGCATCGACCATCGAGGAATGCACACAGGAGGCTGTAGCCCA
AAAACAAAGCCCCACATAAAAGAGGAATGCATCGTACCCACTCCCTGCTATAAACCCAAA
GAGAAACTTCCAGTCGAGGCCAAGTTGCCATGGTTCAAACAAGCTCAAGAGCTAGAAGAA
GGAGCTGCTGTGTCAGAGGAGCCCTCGTAAGTTGTAAAAGCACAGACTGTTCTATATTTG
AAACTGTTTTGTTTAAAGAAAGCAGTGTCTCACTGGTTGTAGCTTTCATGGGTTCTGAAC
TAAGTGTAATCATCTCACCAAAGCTTTTGGCTCTCAAATTAAAGATTGATTAGTTTCAA
AAAAAAAA

FIGURE 144

MECCRRATPGTLLLFLAFLLLSSRTARSEEDRDGLWDAWGPWSECSRTCGGGASYSLRRC
LSSKSCEGRNIRYRTCSNVDCPPEAGDFRAQQCSAHNDVKHHGQFYEWLPVSNDPDNPCS
LKCQAKGTTLVVELAPKVLDGTRCYTESLDMCISGLCQIVGCDHQLGSTVKEDNCGVCNG
DGSTCRLVRGQYKSQLSATKSDDTVVALPYGSRHIRLVLKGPDHLYLETKTLQGTKGENS
LSSTGTFLVDNSSVDFQKFPDKEILRMAGPLTADFIVKIRNSGSADSTVQFIFYQPIIHR
WRETDFFPCSATCGGGYQLTSAECYDLRSNRVVADQYCHYYPENIKPKPKLQECNLDPCP
ASDGYKQIMPYDLYHPLPRWEATPWTACSSSCGGGIQSRAVSCVEEDIQGHVTSVEEWKC
MYTPKMPIAQPCNIFDCPKWLAQEWSPCTVTCGQGLRYRVVLCIDHRGMHTGGCSPKTKP
HIKEECIVPTPCYKPKEKLPVEAKLPWFKQAQELEEGAAVSEEPS

Important features:
Signal peptide:
amino acids 1-25

N-glycosylation site:
amino acids 251-254

Thrombospondin 1:
amino acids 385-399 von Willebrand factor type C domain proteins:
amino acids 385-399, 445-459 and 42-56

FIGURE 145

```
GGAGGAGGGAGGGCGGGCAGGCGCCAGCCCAGAGCAGCCCCGGGCACCAGCACGGACTCT
CTCTTCCAGCCCAGGTGCCCCCACTCTCGCTCCATTCGGCGGGAGCACCCAGTCCTGTA
CGCCAAGGAACTGGTCCTGGGGGCACCATGGTTTCGGCGGCAGCCCCAGCCTCCTCATC
CTTCTGTTGCTGCTGCTGGGGTCTGTGCCTGCTACCGACGCCCGCTCTGTGCCCCTGAAG
GCCACGTTCCTGGAGGATGTGGCGGGTAGTGGGGAGGCCGAGGGCTCGTCGGCCTCCTCC
CCGAGCCTCCCGCCACCCTGGACCCCGGCCCTCAGCCCCACATCGATGGGCCCCAGCCC
ACAACCCTGGGGGGCCCATCACCCCCCACCAACTTCCTGGATGGGATAGTGGACTTCTTC
CGCCAGTACGTGATGCTGATTGCTGTGGTGGGCTCCCTGGCCTTTCTGCTGATGTTCATC
GTCTGTGCCGCGGTCATCACCCGGCAGAAGCAGAAGGCCTCGGCCTATTACCCATCGTCC
TTCCCCAAGAAGAAGTACGTGGACCAGAGTGACCGGGCCGGGGGCCCCGGGCCTTCAGT
GAGGTCCCCGACAGAGCCCCCGACAGCAGGCCCGAGGAAGCCCTGGATTCCTCCCGGCAG
CTCCAGGCCGACATCTTGGCCGCCACCCAGAACCTCAAGTCCCCCACCAGGGCTGCACTG
GGCGGTGGGGACGGAGCCAGGATGGTGGAGGGCAGGGGCGCAGAGGAAGAGGAGAAGGGC
AGCCAGGAGGGGGACCAGGAAGTCCAGGGACATGGGTCCCAGTGGAGACACCAGAGGCG
CAGGAGGAGCCGTGCTCAGGGGTCCTTGAGGGGCTGTGGTGGCCGGTGAGGGCCAAGGG
GAGCTGGAAGGGTCTCTCTTGTTAGCCCAGGAAGCCCAGGGACCAGTGGGTCCCCCGAA
AGCCCCTGTGCTTGCAGCAGTGTCCACCCCAGTGTCTAACAGTCCTCCCGGGCTGCCAGC
CCTGACTGTCGGGCCCCAAGTGGTCACCTCCCGTGTATGAAAAGGCCTTCAGCCCTGA
CTGCTTCCTGACACTCCCTCCTTGGCCTCCCTGTGGTGCCAATCCCAGCATGTGCTGATT
CTACAGCAGGCAGAAATGCTGGTCCCCGGTGCCCCGGAGGAATCTTACCAAGTGCCATCA
TCCTTCACCTCAGCAGCCCCAAAGGGCTACATCCTACAGCACAGCTCCCCTGACAAAGTG
AGGGAGGGCACGTGTCCCTGTGACAGCCAGGATAAAACATCCCCCAAAGTGCTGGGATTA
CAGGCGTGAGCCACCGTGCCCGGCCCAAACTACTTTTTAAAACAGCTACAGGGTAAAATC
CTGCAGCACCCACTCTGGAAAATACTGCTCTTAATTTTCCTGAAGGTGGCCCCCTGTTTC
TAGTTGGTCCAGGATTAGGGATGTGGGGTATAGGGCATTTAAATCCTCTCAAGCGCTCTC
CAAGCACCCCCGGCCTGGGGGTGAGTTTCTCATCCCGCTACTGCTGCTGGGATCAGGTTG
AATGAATGGAACTCTTCCTGTCTGGCCTCCAAAGCAGCCTAGAAGCTGAGGGGCTGTGTT
TGAGGGGACCTCCACCCTGGGGAAGTCCGAGGGGCTGGGGAAGGGTTTCTGACGCCCAGC
CTGGAGCAGGGGGGCCCTGGCCACCCCTGTTGCTCACACATTGTCTGGCAGCCTGTGTC
CACAATATTCGTCAGTCCTCGACAGGGAGCCTGGGCTCCGTCCTGCTTTAGGGAGGCTCT
GGCAGGAGGTCCTCTCCCCATCCCTCCATCTGGGGCTCCCCCAACCTCTGCACAGCTCT
CCAGGTGCTGAGATATAATGCACCAGCACAATAAACCTTTATTCCGGCCTGAAAAAAAAA
AAAAAAAAAAAAAAAAAAAAAAAAAAAAAAAAAAAAAAAAGA
```

FIGURE 146

MVSAAAPSLLILLLLLLGSVPATDARSVPLKATFLEDVAGSGEAEGSSASSPSLPPPWTP
ALSPTSMGPQPTTLGGPSPPTNFLDGIVDFFRQYVMLIAVVGSLAFLLMFIVCAAVITRQ
KQKASAYYPSSFPKKKYVDQSDRAGGPRAFSEVPDRAPDSRPEEALDSSRQLQADILAAT
QNLKSPTRAALGGGDGARMVEGRGAEEEEKGSQEGDQEVQGHGVPVETPEAQEEPCSGVL
EGAVVAGEGQGELEGSLLLAQEAQGPVGPPESPCACSSVHPSV

Signal peptide:
amino acids 1-25

Transmembrane domain:
amino acids 94-118

N-myristoylation site:
amino acids 18-24, 40-46, 46-52, 145-151, 192-198, 193-199, 211-217, 238-244, 242-248

FIGURE 147

```
GAAAGACGTGGTCCTGACAGACAGACAATCCTATTCCCTACCAAAATGAAGATGCTGCTG
CTGCTGTGTTTGGGACTGACCCTAGTCTGTGTCCATGCAGAAGAAGCTAGTTCTACGGGA
AGGAACTTTAATGTAGAAAAGATTAATGGGGAATGGCATACTATTATCCTGGCCTCTGAC
AAAAGAGAAAAGATAGAAGAACATGGCAACTTTAGACTTTTTCTGGAGCAAATCCATGTC
TTGGAGAATTCCTTAGTTCTTAAAGTCCATACTGTAAGAGATGAAGAGTGCTCCGAATTA
TCTATGGTTGCTGACAAAACAGAAAAGGCTGGTGAATATTCTGTGACGTATGATGGATTC
AATACATTTACTATACCTAAGACAGACTATGATAACTTTCTTATGGCTCACCTCATTAAC
GAAAAGGATGGGGAAACCTTCCAGCTGATGGGGCTCTATGGCCGAGAACCAGATTTGAGT
TCAGACATCAAGGAAAGGTTTGCACAACTATGTGAGGAGCATGGAATCCTTAGAGAAAAT
ATCATTGACCTATCCAATGCCAATCGCTGCCTCCAGGCCCGAGAATGAAGAATGGCCTGA
GCCTCCAGTGTTGAGTGGACACTTCTCACCAGGACTCCACCATCATCCCTTCCTATCCAT
ACAGCATCCCCAGTATAAATTCTGTGATCTGCATTCCATCCTGTCTCACTGAGAAGTCCA
ATTCCAGTCTATCAACATGTTACCTAGGATACCTCATCAAGAATCAAAGACTTCTTTAAA
TTTCTCTTTGATACACCCTTGACAATTTTTCATGAAATTATTCCTCTTCCTGTTCAATAA
ATGATTACCCTTGCACTTAA
```

FIGURE 148

MKMLLLLCLGLTLVCVHAEEASSTGRNFNVEKINGEWHTIILASDKREKIEEHGNFRLFL
EQIHVLENSLVLKVHTVRDEECSELSMVADKTEKAGEYSVTYDGFNTFTIPKTDYDNFLM
AHLINEKDGETFQLMGLYGREPDLSSDIKERFAQLCEEHGILRENIIDLSNANRCLQARE

FIGURE 149

```
GTGGACTCTGAGAAGCCCAGGCAGTTGAGGACAGGAGAGAGAAGGCTGCAGACCCAGAGG
GAGGGAGGACAGGGAGTCGGAAGGAGGAGGACAGAGGAGGGCACAGAGACGCAGAGCAAG
GGCGGCAAGGAGGAGACCCTGGTGGGAGGAAGACACTCTGGAGAGAGAGGGGCTGGGCA
GAGATGAAGTTCCAGGGGCCCCTGGCCTGCCTCCTGCTGGCCCTCTGCCTGGGCAGTGGG
GAGGCTGGCCCCTGCAGAGCGGAGAGGAAAGCACTGGGACAAATATTGGGGAGGCCCTT
GGACATGGCCTGGGAGACGCCCTGAGCGAAGGGTGGGAAAGGCCATTGGCAAAGAGGCC
GGAGGGGCAGCTGGCTCTAAAGTCAGTGAGGCCCTTGGCCAAGGGACCAGAGAAGCAGTT
GGCACTGGAGTCAGGCAGGTTCCAGGCTTTGGCGCAGCAGATGCTTTGGGCAACAGGGTC
GGGGAAGCAGCCCATGCTCTGGGAAACACTGGGCACGAGATTGGCAGACAGGCAGAAGAT
GTCATTCGACACGGAGCAGATGCTGTCCGCGGCTCCTGGCAGGGGTGCCTGGCCACAGT
GGTGCTTGGGAAACTTCTGGAGGCCATGGCATCTTTGGCTCTCAAGGTGGCCTTGGAGGC
CAGGGCCAGGGCAATCCTGGAGGTCTGGGGACTCCGTGGGTCCACGGATACCCCGGAAAC
TCAGCAGGCAGCTTTGGAATGAATCCTCAGGGAGCTCCTGGGGTCAAGGAGGCAATGGA
GGGCCACCAAACTTTGGGACCAACACTCAGGGAGCTGTGGCCCAGCCTGGCTATGGTTCA
GTGAGAGCCAGCAACCAGAATGAAGGGTGCACGAATCCCCACCATCTGGCTCAGGTGGA
GGCTCCAGCAACTCTGGGGGAGGCAGCGGCTCACAGTCGGGCAGCAGTGGCAGTGGCAGC
AATGGTGACAACAACAATGGCAGCAGCAGTGGTGGCAGCAGCAGTGGCAGCAGCAGTGGC
AGCAGCAGTGGCGGCAGCAGTGGCGGCAGCAGTGGTGGCAGCAGTGGCAACAGTGGTGGC
AGCAGAGGTGACAGCGGCAGTGAGTCCTCCTGGGGATCCAGCACCGGCTCCTCCTCCGGC
AACCACGGTGGGAGCGGCGGAGGAAATGGACATAAACCCGGGTGTGAAAGCCAGGGAAT
GAAGCCCGCGGGAGCGGGAATCTGGGATTCAGGGCTTCAGAGGACAGGGAGTTTCCAGC
AACATGAGGGAAATAAGCAAAGAGGGCAATCGCCTCCTTGGAGGCTCTGGAGACAATTAT
CGGGGGCAAGGGTCGAGCTGGGCAGTGGAGGAGGTGACGCTGTTGGTGGAGTCAATACT
GTGAACTCTGAGACGTCTCCTGGGATGTTTAACTTTGACACTTTCTGGAAGAATTTTAAA
TCCAAGCTGGGTTTCATCAACTGGGATGCCATAAACAAGGACCAGAGAAGCTCTCGCATC
CCGTGACCTCCAGACAAGGAGCCACCAGATTGGATGGGAGCCCCCACACTCCCTCCTTAA
AACACCACCCTCTCATCACTAATCTCAGCCCTTGCCCTTGAAATAAACCTTAGCTGCCCC
ACAAAAAAAAAAAAAAAAAAAAAAAAAAAAAAAAAAAAAAAAAAAAAAAAAAAAAAAAAA
AAAAAAAAAAAAAAAAAAAAAAAAAAAAAAAAAAAAAAAAAAAAAAAAA
```

FIGURE 150

MKFQGPLACLLLALCLGSGEAGPLQSGEESTGTNIGEALGHGLGDALSEGVGKAIGKEAG
GAAGSKVSEALGQGTREAVGTGVRQVPGFGAADALGNRVGEAAHALGNTGHEIGRQAEDV
IRHGADAVRGSWQGVPGHSGAWETSGGHGIFGSQGGLGGQGQCNPGGLGTPWVHGYPGNS
AGSFGMNPQGAPWGQGGNCCPPNFGTNTQGAVAQPGYGSVRASNQNEGCTNPPPSGSGGG
SSNSGGGSGSQSGSSGSGSNGDNNNGSSSGGSSSGSSSGSSSGGSSGGSSGGSSGNSGGS
RGDSGSESSWGSSTGSSSGNHGGSGGGNGHKPGCEKPGNEARGSGESGIQGFRGQGVSSN
MREISKEGNRLLGGSGDNYRGQGSSWGSGGGDAVGGVNTVNSETSPGMFNFDTFWKNFKS
KLGFINWDAINKDQRSSRIP

Signal peptide:
amino acids 1-21

N-glycosylation site:
amino acids 265-269

Glycosaminoglycan attachment site:
amino acids 235-239, 237-241, 244-248, 255-259, 324-328, 388-392

Casein kinase II phosphorylation site:
amino acids 26-30, 109-113, 259-263, 300-304, 304-308

N-myristoylation site:
amino acids 17-23, 32-38, 42-48, 50-56, 60-66, 61-67, 64-70, 74-80, 90-96, 96-102, 130-136, 140-146, 149-155, 152-158, 155-161, 159-165, 163-169, 178-184, 190-196, 194-200, 199-205, 218-224, 236-242, 238-244, 239-245, 240-246, 245-251, 246-252, 249-252, 253-259, 256-262, 266-272, 270-276, 271-277, 275-281, 279-285, 283-289, 284-290, 287-293, 288-294, 291-297, 292-298, 295-301, 298-304, 305-311, 311-317, 315-321, 319-325, 322-328, 323-329, 325-331, 343-349, 354-360, 356-362, 374-380, 381-387, 383-389, 387-393, 389-395, 395-401

Cell attachment sequence:
amino acids 301-304

FIGURE 151

```
CGGCCACAGCTGGCATGCTCTGCCTGATCGCCATCCTGCTGTATGTCCTCGTCCAGTACC
TCGTGAACCCCGGGGTGCTCCGCACGGACCCCAGATGTCAAGAATATGAACACGTGGCTG
CTGTTCCTCCCCCTGTTCCCGGTGCAGGTGCAGACCCTGATAGTCGTGATCATCGGGATG
CTCGTGCTCCTGCTGGACTTTCTTGGCTTGGTGCACCTGGGCCAGCTGCTCATCTTCCAC
ATCTACCTGAGTATGTCCCCCACCCTAAGCCCCCGATCCCCCCAAGGCTGGGTGGTCAGA
GCTGCTCATCTTACACCTCTACTTGAGTATGTCCCTAACCCTGAGCCCCCCACGCCTGGG
GCCAGAGTCTTTGTCCCCCGTGTGCGCATGTGTTCAGGGTCAGCCTCTCCCAGAAGTGAG
ATCATGGACAAAAGGGCAAATCACAGGAAGAAATTAAATCCATGAGGACCCAGCAGGCC
CAGCAAGAAGCTGAACTCACGCCGAGACCTGCAGGAGTGGTGCCAGGTGCTTGAAGTAAC
AAGTTTAAAATGTTCAGAGACAATGGAATGGAATCTATTAGGCAAGAACAGGACATTATG
AAATAAGGACAGGTGGACTTCCAAAAACACAAGTAGAAATTCTAACAATGAAATATATTA
CAGGCAGGTCACCCACTAACCAAACAACTGAAGCGAGAGCTGTGGTCTTGCTTGGTCTCA
CAGTGGGCACAGCGGTAGCGGTCAGTCATGTTGCTGAACGACGGAGGGTAAACTCCCCA
GCCCCAAGAAAACCTGTGTTGGAAGTAACAACAACCTCCCTGCTCCTGGCACCAGCCGTT
TTGGTCATGGTGGGCCAGCTGCAAAGCGTCTTCCATTCTCTGGGCAGTGGTGGCCCCGAG
GCTGTGGCCTCTCAGGGGGTTTCTGTGGACACGGGCAGCAGAGTGTGTCCAGGCCAGCCC
CCAAGAATGCCCTGCTCCTGACAGCTTGGCCAACCCCTGGTCAGGGCAGAGGGAGTTGGG
TGGGTCAGGCTCTGGGCTCACCTCCATCTCCAGAGCATCCCCTGCCTGCAGTTGTGGCAA
GAACGCCCAGCTCAGAATGAACACACCCCACCAAGAGCCTCCTTGTTCATAACCACAGGT
TACCCTACAAACCACTGTCCCCACACAACCCTGGGGATGTTTTAAAACACACACCTCTAA
CGCATATCTTACAGTCACTGTTGTCTTGCCTGAGGGTTGAATTTTTTTTAATGAAAGTGC
AATGAAAATCACTGGATTAAATCCTACGGACACAGAGCTGAAAAAAAAAAAAAAAAAAA
AAAAAAAAAAA
```

FIGURE 152

MNTWLLFLPLFPVQVQTLIVVIIGMLVLLLDFLGLVHLGQLLIFHIYLSMSPTLSPRSPQ
GWVVRAAHLTPLLEYVPNPEPPTPGARVFVPRVRMCSGSASPRSEIMDKKGKSQEEIKSM
RTQQAQQEAELTPRPAGVVPGA

FIGURE 153

```
AACTGGAAGGAAAGAAAGAAAGGTCAGCTTTGGCCCAGATGTGGTTACCCCTTGGTCTCC
TGTCTTTATGTCTTTCTCCTCTTCCTATTCTGTCATCTCCCTCACTTAAGTCTCAGGCCT
GTCAGCAGCTCCTGTGGACATTGCCATCCCCTCTGGTAGCCTTCAGAGCAAACAGGACAA
CCTATGTTATGGATGTTTCCACCAACCAGGGTAGTGGCATGGAGCACCGTAACCATCTGT
GCTTCTGTGATCTCTATGACAGAGCCACTTCTCCACCTCTGAAATGTTCCCTGCTCTGAA
ATCTGGCATGAGATGGCACAGGTGACCACGCAGAAGCCACCAGAATCTTGCCTGCCCTAT
TCCTCCTCCCAAGTCTGTTCTCTTATTGTCAACCTCAGCACAACAGGCTGGCGCCAATGG
CATTACAGAGAAAGCAATCTGTGTGGCTAGTGGGCAGATTACCATGCAAGCCCCAGGAGA
AATGGAGGAGCTTTGTAGCCACCTCCCTGTCAGCCAGTATTAACATGTCCCCTTCCCCCT
GCCCCGCCGTAGATTCAGGACATTCGCCCTGTGTGCCACCAAACCAGGACTTTCCCCTT
GGCTTGGCATCCCTGGCTCTCTCCTGGTACCCAGCAAGACGTCTGTTCCAGGGCAGTGTA
GCATCTTTCAAGCTCCGTTACTATGGCGATGGCCATGATGTTACAATCCCACTTGCCTGA
ATAATCAAGTGGGAAGGGGAAGCAGAGGGAAATGGGGCCATGTGAATGCAGCTGCTCTGT
TCTCCCTACCCTGAGGAAAAACCAAAGGGAAGCAACAGGAACTTCTGCAACTGGTTTTTA
TCGGAAAGATCATCCTGCCTGCAGATGCTGTTGAAGGGGCACAAGAAATGTAGCTGGAGA
AGATTGATGAAAGTGCAGGTGTGTAAGGAAATAGAACAGTCTGCTGGGAGTCAGACCTGG
AATTCTGATTCCAAACTCTTTATTACTTTGGGAAGTCACTCAGCCTCCCCGTAGCCATCT
CCAGGGTGACGGAACCCAGTGTATTACCTGCTGGAACCAAGGAAACTAACAATGTAGGTT
ACTAGTGAATACCCCAATGGTTTCTCCAATTATGCCCATGCCACCAAAACAATAAAACAA
AATTCTCTAACACTGAAA
```

FIGURE 154

MWLPLGLLSLCLSPLPILSSPSLKSQACQQLLWTLPSPLVAFRANRTTYVMDVSTNQGSG
MEHRNHLCFCDLYDRATSPPLKCSLL

FIGURE 155

```
GTAGCGCGTCTTGGGTCTCCCGGCTGCCGCTGCTGCCGCCGCCGCCTCGGGTCGTGGAGC
CAGGAGCGACGTCACCGCCATGGCAGGCATCAAAGCTTTGATTAGTTTGTCCTTTGGAGG
AGCAATCGGACTGATGTTTTTGATGCTTGGATGTGCCCTTCCAATATACAACAAATACTG
GCCCCTCTTTGTTCTATTTTTTTACATCCTTTCACCTATTCCATACTGCATAGCAAGAAG
ATTAGTGGATGATACAGATGCTATGAGTAACGCTTGTAAGGAACTTGCCATCTTTCTTAC
AACGGGCATTGTCGTGTCAGCTTTTGGACTCCCTATTGTATTTGCCAGAGCACATCTGAT
TGAGTGGGGAGCTTGTGCACTTGTTCTCACAGGAAACACAGTCATCTTTGCAACTATACT
AGGCTTTTTCTTGGTCTTTGGAAGCAATGACGACTTCAGCTGGCAGCAGTGGTGAAAAGA
AATTACTGAACTATTGTCAAATGGACTTCCTGTCATTTGTTGGCCATTCACGCACACAGG
AGATGGGGCAGTTAATGCTAATGGTATAGCAAGCCTCTTGGGGGTATTTTAGGTGCTCC
CTTCTCACTTTTATTGTAAGCATACTATTTTCACAGAGACTTGCTGAAGGATTAAAAGGA
TTTTCTCTTTTGGAAAAGCTTGACTGATTTCACACTTATCTATAGTATGCTTTTTGTGGT
GTCCTGCTGAATTTAAATATTTATGTGTTTTTCCTGTTAGGTTGATTTTTTTGGAATCA
ATATGCAATGTTAAACACTTTTTTAATGTAATCATTTGCATTGGTTAGGAATTCAGAATT
CCGCCGGCTCTATTACTGGTCAAGTACATCTTTTCTCTTAAAATTATTTAGCCTCCATTA
TTACAAAAAATTATAAAAATAAGTTTTCAGTCAGTCAGGATGACATCACTCCCAATGTTA
TGCAGACATACAGACGGTTGGCATACGTTATAGACTGTATACTCAGTGCAAATATAGCTG
CATTTATACCTCAGAGGGGCCAAGTGTTAATGCCCATGCCCTCCGTTAAGGGTTGTTGGT
TTTACTGGTAGACAGATGTTTTGTGGATTGAAAATTATTTATGGAATTGCTACAGAGGA
GTGCTTTTCTTCTCAATTGTTAGAAGAATTTATGTTAAACTTTAAGGTAAGGGTGTAAAA
ACATTTTTGAGATAAGGTTTTTATTTATGTTTATTATTGTTAGAGTGAGTTGCAATGTGG
GAAGAAATGACATTGAAATTCCAGTTTTTGAATCCTGTTTCTATTTATAAGTGAAATTTG
TGATCTCCTATCAACCTTTCATGTTTTACCCTGTTAAAATGGACATACATGGAACCACTA
CTGATGAGGGACAGTTGTATGTTTGCATCATATATGCCAGAAAACCTTCCTCTGCTTCCT
CCTTTTGACTTATTTGGTATGTTGTATATATTACATAAAATAACTTTTCAAATATAGTTT
AATAACACTTAGAAGTGTTTACTTACCTGGAAAATAATTGCTATGCCGTACATTCAGAGT
GCCCCCTCCCCTGCAAGGCCTTGCCATGATTAACAAGTAACTTGTTAGTCTTACAGATAA
TTCATGCATTAACAGTTTAAGATTTAGACCATGGTAATAGTAGTTCTTATTCTCTAAGGT
TATATCATATGTAATTTAAAAGTATTTTAAGACAAGTTTCCTGTATACCTCTGAACTGT
TTTGATTTTGAGTTCATCATGATAGATCTGCTGTTTCCTTATAAAAGGCATTTGTTGTGT
GAGTTAATGCAAAGTAGCCAAGTCCAGCTATATAGCAGCTTCAGAAACATACCTGACCAA
AAAATTCCCAGTAACCAGGCATGATCAATTTATAGTGGTCGTTTACATCTAATAATTATC
AGGACTTTTTCAGGAGTGGGTTATAAAAACATTCAAGTTGGTCTGACAGTATTTTGTTA
AGGATATTTGTTTGTATGTTTATTCAGTATACTTACATAAAAATTATTTCGCCATCAGCC
AAAACTCAGTAATCATGACAGCTGTCTGTTGTTTATGAAGTTTATTTCTCAAGAAAATG
GGAATAAATTTGGGATTTGTTCAGCTTTTTTACTAAAGATGCCTAAAGCCACAGGTTTTA
TTGCCTAACTTAAGCCATGACTTTTAGATATGAGATGACGGGAAGCAGGACGAAATATCG
GCGTGTGGCTGGAGCCTTCCCACTGGAGGCTGAAAGTGGCTTGTGGTATTATAATGTTCA
GATTTCAAGAGGAAGGTGCAGGTACACATGAGTTAGAGAGCTGGTGAGACAGTTGGGAAC
TCTTTGTGCTTGTGATCTACTGGACTTTTTTTTGCAGGAAGTGCATTCTCTGGTCCTTC
CCTATTTTCTGTTCTGGATGTCAGTGCAGTGCACTGCTACTGTTTATCCACTTGGCCAC
AGACTTTTTCTAACAGCTGCGTATTATTTCTATATACTAATTGCATTGGCAGCATTGTGT
CTTTGACCTTGTATACTAGCTTGACATAGTGCTGTCTCTGATTTCTAGGCTAGTTACTTG
AGATATGAATTTTCCATAGAATATGCACTGATACAACATTACCATTCTTCATGGAAAGA
AAACTTTTGATGATGAAACAATAAAGATTTTAAATATCTATTTTAAAAAAAAAA
```

FIGURE 156

MAGIKALISLSFGGAIGLMFLMLGCALPIYNKYWPLFVLFFYILSPIPYCIARRLVDDTD
AMSNACKELAIFLTTGIVVSAFGLPIVFARAHLIEWGACALVLTGNTVIFATILGFFLVF
GSNDDFSWQQW

FIGURE 157

```
GTTTCTCATAGTTGGCGTCTTCTAAAGGAAAAACACTAAAATGAGGAACTCAGCGGACCG
GGAGCGACGCAGCTTGAGGGAAGCATCCCTAGCTGTTGGCGCAGAGGGGCGAGGCTGAAG
CCGAGTGGCCCGAGGTGTCTGAGGGGCTGGGGCAAAGGTGAAAGAGTTTCAGAACAAGCT
TCCTGGAACCCATGACCCATGAAGTCTTGTCGACATTTATACCGTCTGAGGGTAGCAGCT
CGAAACTAGAAGAAGTGGAGTGTTGCCAGGGACGGCAGTATCTCTTTGTGTGACCCTGGC
GGCCTATGGGACGTTGGCTTCAGACCTTTGTGATACACCATGCTGCGTGGGACGATGACG
GCGTGGAGAGGAATGAGGCCTGAGGTCACACTGGCTTGCCTCCTCCTAGCCACAGCAGGC
TGCTTTGCTGACTTGAACGAGGTCCCTCAGGTCACCGTCCAGCCTGCGTCCACCGTCCAG
AAGCCCGGAGGCACTGTGATCTTGGGCTGCGTGGTGGAACCTCCAAGGATGAATGTAACC
TGGCGCCTGAATGGAAAGGAGCTGAATGGCTCGGATGATGCTCTGGGTGTCCTCATCACC
CACGGGACCCTCGTCATCACTGCCCTTAACAACCACACTGTGGGACGGTACCAGTGTGTG
GCCCGGATGCCTGCGGGGCTGTGGCCAGCGTGCCAGCCACTGTGACACTAGCCAATCTC
CAGGACTTCAAGTTAGATGTGCAGCACGTGATTGAAGTGGATGAGGGAAACACAGCAGTC
ATTGCCTGCCACCTGCCTGAGAGCCACCCCAAAGCCCAGGTCCGGTACAGCGTCAAACAA
GAGTGGCTGGAGGCCTCCAGAGGTAACTACCTGATCATGCCCTCAGGGAACCTCCAGATT
GTGAATGCCAGCCAGGAGGACGAGGGCATGTACAAGTGTGCAGCCTACAACCCAGTGACC
CAGGAAGTGAAAACCTCCGGCTCCAGCGACAGGCTACGTGTGCGCCGCTCCACCGCTGAG
GCTGCCCGCATCATCTACCCCCAGAGGCCCAAACCATCATCGTCACCAAAGGCCAGAGT
CTCATTCTGGAGTGTGTGGCCAGTGGAATCCCACCCCCACGGGTCACCTGGGCCAAGGAT
GGGTCCAGTGTCACCGGCTACAACAAGACGCGCTTCCTGCTGAGCAACCTCCTCATCGAC
ACCACCAGCGAGGAGGACTCAGGCACCTACCGCTGCATGGCCGACAATGGGGTTGGGCAG
CCCGGGGCAGCGGTCATCCTCTACAATGTCCAGGTGTTTGAACCCCCTGAGGTCACCATG
GAGCTATCCCAGCTGGTCATCCCCTGGGGCCAGAGTGCCAAGCTTACCTGTGAGGTGCGT
GGGAACCCCCCGCCCTCCGTGCTGTGGCTGAGGAATGCTGTGCCCCTCATCTCCAGCCAG
CGCCTCCGGCTCTCCCGCAGGGCCCTGCGCGTGCTCAGCATGGGGCCTGAGGACGAAGGC
GTCTACCAGTGCATGGCCGAGAACGAGGTTGGGAGCGCCCATGCCGTAGTCCAGCTGCGG
ACCTCCAGGCCAAGCATAACCCCAAGGCTATGGCAGGATGCTGAGCTGGCTACTGGCACA
CCTCCTGTATCACCCTCCAAACTCGGCAACCCTGAGCAGATGCTGAGGGGGCAACCGGCG
CTCCCCAGACCCCCAACGTCAGTGGGGCCTGCTTCCCCGAAGTGTCCAGGAGAGAAGGGG
CAGGGGGCTCCCGCCGAGGCTCCCATCATCCTCAGCTCGCCCGCACCTCCAAGACAGAC
TCATATGAACTGGTGTGGCGGCCTCGGCATGAGGGCAGTGGCCGGGCGCCAATCCTCTAC
TATGTGGTGAAACACCGCAAGCAGGTCACAAATTCCTCTGACGATTGGACCATCTCTGGC
ATTCCAGCCAACCAGCACCGCCTGACCCTCACCAGACTTGACCCCGGGAGCTTGTATGAA
GTGGAGATGGCAGCTTACAACTGTGCGGGAGAGGGCCAGACAGCCATGGTCACCTTCCGA
ACTGGACGGCGGCCCAAACCCGAGATCATGGCCAGCAAAGAGCAGCAGATCCAGAGAGAC
GACCCTGGAGCCAGTCCCCAGAGCAGCAGCCAGCCAGACCACGGCCGCCTCTCCCCCCA
GAAGCTCCCGACAGGCCCACCATCTCCACGGCCTCCGAGACCTCAGTGTACGTGACCTGG
ATTCCCCGTGGGAATGGTGGGTTCCCAATCCAGTCCTTCCGTGTGGAGTACAAGAAGCTA
AAGAAAGTGGGAGACTGGATTCTGGCCACCAGCGCCATCCCCCCATCGCGGCTGTCCGTG
GAGATCACGGGCCTAGAGAAAGGCACCTCCTACAAGTTTCGAGTCCGGCTCTGAACATG
CTGGGGGAGAGCGAGCCCAGCGCCCCTCTCGGCCCTACGTGGTGTCGGGCTACAGCGGT
CGCGTGTACGAGAGGCCCGTGGCAGGTCCTTATATCACCTTCACGGATGCGGTCAATGAG
ACCACCATCATGCTCAAGTGGATGTACATCCCAGCAAGTAACAACAACACCCCAATCCAT
GGCTTTTATATCTATTATCGACCCACAGACAGTGACAATGATAGTGACTACAAGAAGGAT
ATGGTGGAAGGGGACAAGTACTGGCACTCCATCAGCCACCTGCAGCCAGAGACCTCCTAC
GACATTAAGATGCAGTGCTTCAATGAAGGAGGGGAGAGCGAGTTCAGCAACGTGATGATC
TGTGAGACCAAAGCTCGGAAGTCTTCTGGCCAGCCTGGTCGACTGCCACCCCCAACTCTG
GCCCCACCACAGCCGCCCCTTCCTGAAACCATAGAGCGGCCGGTGGGCACTGGGGCCATG
GTGGCTCGCTCCAGCGACCTGCCCTATCTGATTGTCGGGGTCGTCCTGGGCTCCATCGTT
CTCATCATCGTCACCTTCATCCCCTTCTGCTTGTGGAGGGCCTGGTCTAAGCAAAAACAT
ACAACAGACCTGGGTTTTCCTCGAAGTGCCCTTCCACCCTCCTGCCCGTATACTATGGTG
CCATTGGGAGGACTCCCAGGCCACCAGGCCAGTGGACAGCCCTACCTCAGTGGCATCAGT
```

FIGURE 157
(continued)

```
GGACGGGCCTGTGCTAATGGGATCCACATGAATAGGGGCTGCCCCTCGGCTGCAGTGGGC
TACCCGGGCATGAAGCCCCAGCAGCACTGCCCAGGCGAGCTTCAGCAGCAGAGTGACACC
AGCAGCCTGCTGAGGCAGACCCATCTTGGCAATGGATATGACCCCCAAAGTCACCAGATC
ACGAGGGGTCCCAAGTCTAGCCCGGACGAGGGCTCTTTCTTATACACACTGCCCGACGAC
TCCACTCACCAGCTGCTGCAGCCCCATCACGACTGCTGCCAACGCAGGAGCAGCCTGCT
GCTGTGGGCCAGTCAGGGGTGAGGAGAGCCCCCGACAGTCCTGTCCTGGAAGCAGTGTGG
GACCCTCCATTTCACTCAGGGCCCCATGCTGCTTGGGCCTTGTGCCAGTTGAAGAGGTG
GACAGTCCTGACTCCTGCCAAGTGAGTGGAGGAGACTGGTGTCCCCAGCACCCCGTAGGG
GCCTACGTAGGACAGGAACCTGGAATGCAGCTCTCCCCGGGGCCACTGGTGCGTGTGTCT
TTTGAAACACCACCTCTCACAATTTAGGCAGAAGCTGATATCCCAGAAAGACTATATATT
GTTTTTTTTTTAAAAAAAAAAGAAGAAAAAGAGACAGAGAAAATTGGTATTTATTTTTC
TATTATAGCCATATTTATATATTTATGCACTTGTAAATAAATGTATATGTTTTATAATTC
TGGAGAGACATAAGGAGTCCTACCCGTTGAGGTTGGAGAGGGAAAATAAAGAAGCTGCCA
CCTAACAGGAGTCACCCAGGAAAGCACCGCACAGGCTGGCGCGGGACAGACTCCTAACCT
GGGGCCTCTGCAGTGGCAGGCGAGGCTGCAGGAGGCCCACAGATAAGCTGGCAAGAGGAA
GGATCCCAGGCACATGGTTCATCACGAGCATGAGGGAACAGCAAGGGGCACGGTATCACA
GCCTGGAGACACCCACACAGATGGCTGGATCCGGTGCTACGGGAAACATTTTCCTAAGAT
GCCCATGAGAACAGACCAAGATGTGTACAGCACTATGAGCATTAAAAAACCTTCCAGAAT
CAATAATCCGTGGCAACATATCTCTGTAAAAACAAACACTGTAACTTCTAAATAAATGTT
TAGTCTTCCCTGTAAAA
```

FIGURE 158

```
MLRGTMTAWRGMRPEVTLACLLLATAGCFADLNEVPQVTVQPASTVQKPGGTVILGCVVE
PPRMNVTWRLNGKELNGSDDALGVLITHGTLVITALNNHTVGRYQCVARMPAGAVASVPA
TVTLANLQDFKLDVQHVIEVDEGNTAVIACHLPESHPKAQVRYSVKQEWLEASRGNYLIM
PSGNLQIVNASQEDEGMYKCAAYNPVTQEVKTSGSSDRLRVRRSTAEAARIIYPPEAQTI
IVTKGQSLILECVASGIPPPRVTWAKDGSSVTGYNKTRFLLSNLLIDTTSEEDSGTYRCM
ADNGVGQPGAAVILYNVQVFEPPEVTMELSQLVIPWGQSAKLTCEVRGNPPPSVLWLRNA
VPLISSQRLRLSRRALRVLSMGPEDEGVYQCMAENEVGSAHAVVQLRTSRPSITPRLWQD
AELATGTPPVSPSKLGNPEQMLRGQPALPRPPTSVGPASPKCPGEKGQGAPAEAPIILSS
PRTSKTDSYELVWRPRHEGSGRAPILYYVVKHRKQVTNSSDDWTISGIPANQHRLTLTRL
DPGSLYEVEMAAYNCAGEGQTAMVTFRTGRRPKPEIMASKEQQIQRDDPGASPQSSSQPD
HGRLSPPEAPDRPTISTASETSVYVTWIPRGNGGFPIQSFRVEYKKLKKVGDWILATSAI
PPSRLSVEITGLEKGTSYKFRVRALNMLGESEPSAPSRPYVVSGYSGRVYERPVAGPYIT
FTDAVNETTIMLKWMYIPASNNNTPIHGFYIYYRPTDSDNDSDYKKDMVEGDKYWHSISH
LQPETSYDIKMQCFNEGGESEFSNVMICETKARKSSGQPGRLPPPTLAPPQPPLPETIER
PVGTGAMVARSSDLPYLIVGVVLGSIVLIIVTFIPFCLWRAWSKQKHTTDLGFPRSALPP
SCPYTMVPLGGLPGHQASGQPYLSGISGRACANGIHMNRGCPSAAVGYPGMKPQQHCPGE
LQQQSDTSSLLRQTHLGNGYDPQSHQITRGPKSSPDEGSFLYTLPDDSTHQLLQPHHDCC
QRQEQPAAVGQSGVRRAPDSPVLEAVWDPPFHSGPPCCLGLVPVEEVDSPDSCQVSGGDW
CPQHPVGAYVGQEPGMQLSPGPLVRVSFETPPLTI
```

Signal peptide:
amino acids 1-30

Transmembrane domain:
amino acids 16-30 (type II), 854-879

FIGURE 159

```
CCCACGCGTCCGCCCACGCGTCCGCCCACGCGTCCGCCCACGCGTCCGCCCACGCGTCCG
CCCACGCGTCCGCCCACGCGTCCGGTGCAAGCTCGCGCCGCACACTGCCTGGTGGAGGGA
AGGAGCCCGGGCGCCTCTCGCCGCTCCCCGCGCCGCCGTCCGCACCTCCCCACCGCCCGC
CGCCCGCCGCCCGCCGCCCGCAAAGCATGAGTGAGCCCGCTCTCTGCAGCTGCCCGGGGC
GCGAATGGCAGGCTGTTTCCGCGGAGTAAAAGGTGGCGCCGGTCAGTGGTCGTTTCCAAT
GACGGACATTAACCAGACTGTCAGATCCTGGGGAGTCGCGAGCCCCGAGTTTGGAGTTTT
TTCCCCCCACAACGTCACAGTCCGAACTGCAGAGGGAAAGGAAGGCGGCAGGAAGGCGAA
GCTCGGGCTCCGGCACGTAGTTGGGAAACTTGCGGGTCCTAGAAGTCGCCTCCCCGCCTT
GCCGGCCGCCCTTGCAGCCCCGAGCCGAGCAGCAAAGTGAGACATTGTGCGCCTGCCAGA
TCCGCCGGCCGCGGACCGGGGCTGCCTCGGAAACACAGAGGGGTCTTCTCTCGCCCTGCA
TATAATTAGCCTGCACACAAAGGGAGCAGCTGAATGGAGGTTGTCACTCTCTGGAAAAGG
ATTTCTGACCGAGCGCTTCCAATGGACATTCTCCAGTCTCTCTGGAAAGATTCTCGCTAA
TGGATTTCCTGCTGCTCGGTCTCTGTCTATACTGGCTGCTGAGGAGGCCCTCGGGGTGG
TCTTGTGTCTGCTGGGGCCTGCTTTCAGATGCTGCCCGCCGCCCCAGCGGGTGCCCGC
AGCTGTGCCGGTGCGAGGGGCGGCTGCTGTACTGCGAGGCGCTCAACCTCACCGAGGCGC
CCCACAACCTGTCCGGCCTGCTGGGCTTGTCCCTGCGCTACAACAGCCTCTCGGAGCTGC
GCGCCGGCCAGTTCACGGGGTTAATGCAGCTCACGTGGCTCTATCTGGATCACAATCACA
TCTGCTCCGTGCAGGGGACGCCTTTCAGAAACTGCGCCGAGTTAAGGAACTCACGCTGA
GTTCCAACCAGATCACCCAACTGCCCAACACCACCTTCCGGCCCATGCCCAACCTGCGCA
GCGTGGACCTCTCGTACAACAAGCTGCAGGCGCTCGCGCCCGACCTCTTCCACGGGCTGC
GGAAGCTCACCACGCTGCATATGCGGGCCAACGCCATCCAGTTTGTGCCCGTGCGCATCT
TCCAGGACTGCCGCAGCCTCAAGTTTCTCGACATCGGATACAATCAGCTCAAGAGTCTGG
CGCGCAACTCTTTCGCCGGCTTGTTTAAGCTCACCGAGCTGCACCTCGAGCACAACGACT
TGGTCAAGGTGAACTTCGCCCACTTCCCGCGCCTCATCTCCCTGCACTCGCTCTGCCTGC
GGAGGAACAAGGTGGCCATTGTGGTCAGCTCGCTGGACTGGGTTTGGAACCTGGAGAAAA
TGGACTTGTCGGGCAACGAGATCGAGTACATGGAGCCCCATGTGTTCGAGACCGTGCCGC
ACCTGCAGTCCCTGCAGCTGGACTCCAACCGCCTCACCTACATCGAGCCCCGGATCCTCA
ACTCTTGGAAGTCCCTGACAAGCATCACCCTGGCCGGGAACCTGTGGGATTGCGGGCGCA
ACGTGTGTGCCCTAGCCTCGTGGCTCAGCAACTTCCAGGGGCGCTACGATGGCAACTTGC
AGTGCGCCAGCCCGGAGTACGCACAGGGCGAGGACGTCCTGGACGCCGTGTACGCCTTCC
ACCTGTGCGAGGATGGGGCCGAGCCCACCAGCGGCCACCTGCTCTCGGCCGTCACCAACC
GCAGTGATCTGGGGCCCCCTGCCAGCTCGGCCACCACGCTCGCGGACGGCGGGGAGGGGC
AGCACGACGGCACATTCGAGCCTGCCACCGTGGCTCTTCCAGGCGGCGAGCACGCCGAGA
ACGCCGTGCAGATCCACAAGGTGGTCACGGGCACCATGGCCCTCATCTTCTCCTTCCTCA
TCGTGGTCCTGGTGCTCTACGTGTCCTGGAAGTGTTTCCAGCCAGCCTCAGGCAGCTCA
GACAGTGCTTTGTCACGCAGCGCAGGAAGCAAAAGCAGAAACAGACCATGCATCAGATGG
CTGCCATGTCTGCCCAGGAATACTACGTTGATTACAAACCGAACCACATTGAGGGAGCCC
TGGTGATCATCAACGAGTATGGCTCGTGTACCTGCCACCAGCAGCCCGCGAGGGAATGCG
AGGTGTGATTGTCCCAGTGGCTCTCAACCCATGCGCTACCAAATACGCCTGGGCAGCCGG
GACGGGCCGGCGGGCACCAGGCTGGGGTCTCCTTGTCTGTGCTCTGATATGCTCCTTGAC
TGAAACTTTAAGGGGATCTCTCCCAGAGACTTGACATTTTAGCTTTATTGTGTCTTAAAA
ACAAAAGCGAATTAAAACACAACAAAAAACCCCACCCCACAACCTTCAGGACAGTCTATC
TTAAATTTCATATGAGAACTCCTTCCTCCCTTTGAAGATCTGTCCATATTCAGGAATCTG
AGAGTGTAAAAAGGTGGCCATAAGACAGAGAGAATAATCGTGCTTTGTTTTATGCTA
CTCCTCCCACCCTGCCCATGATTAAACATCATGTATGTAGAAGATCTTAAGTCCATACGC
ATTTCATGAAGAACCATTGGAAAGAGGAATCTGCAATCTGGGAGCTTAAGAGCAAATGAT
```

FIGURE 159
(continued)

```
GACCATAGAAAGCTATGTTCTTACTTTGTGTGTGTGTCTGTATGTTTCTGCGTTGTGTGT
CTTTGTAGGCAAGCAAACGTTGTCTACACAAACGGGAATTTAGCTCACATCATTTCATGC
CCCTGTGCCTCTAGCTCTGGAGATTGGTGGGGGGAGGTGGGGGGAAACGGCAGGAATAAG
GGAAAGTGGTAGTTTTAACTAAGGTTTTGTAACACTTGAAATCTTTTCTTTCTCAAATTA
ATTATCTTTAAGCTTCAAGAAACTTGCTCTGACCCCTCTAAGCAAACTACTAAGCATTTA
AAAGAGAATCTAATTTTTAAAGGTGTAGCACCTTTTTTTTATTCTTCCCACAGAGGGTG
CTAATCTCATTATGCTGTGCTATCTGAAAAGAACTTAAGGCCACAATTCACGTCTCGTCC
TGGGCATTGTGATGGATTGACCCTCCATTTGCAGTACCTTCCCAGCTGATTAAAGTTCAG
CAGTGGTATTGAGGTTTTTCGAATATTTATATAGAAAAAAAGTCTTTTCACATGACAAAT
GACACTCTCACACCAGTCTTAGCCCTAGTAGTTTTTTAGGTTGGACCAGAGGAAGCAGGT
TAAATGAGACCTGTCCTCTGCTGCACTCAGAAAAAATAGGCAGTCCCTGATGCTCAGATC
TTAGCCTTGATATTAATAGTTGAGACCACCTACCCACAATGCAGCCTATACTCCCAAGAC
TACAAAGTTACCATCGCAAAGGAAAGGTTATTCCAGTAAAAGGAAATAGTTTTCTCAACC
ATTTAAAAATATTCTTCTGAACTCATCAAAGTAGAAGAGCCCCCAACCTTTTCTCTCTGC
CTTCAAGAAGGCAGACATTTGGTATGATTTAGCATCAACAACACATTTATGAGTATATGT
AAGTAATCAGAGGGGCAAATGCCACTTGTTATTCCTCCCAAGTTTTCCAAGCAAGTACAC
ACAGATCTCTGGTAGGATTAGGGGCCACTTGTGTTTCCGGCTTATTTTAGTCGACTTGTC
AGCAAGTTTGATGCCTAGTCTATCTGACATGGCCCAGTAGAACAGGGCATTGATGGATCA
CATGAGATGGTAGAAGGAACATCATCACATACCCTCTCACAGAGAAAATTATCAAAGAA
CCAGAAATTATATCTGTTTTGGAGCAAGAGTGTCATAATGTTTCAGGGTAGTCAAAATAA
ACATAAATTATCTCCTCTAGATGAGTGGCGATGTTGGCTGATTTGGGTCTGCCATTGACA
GAATGTCAAATAAAAAGGAATTAGCTAGAATATGACCATTAAATGTGCTTCTGAAATATA
TTTTGAGATAGGTTTAGAATGTCA
```

FIGURE 160

```
MDFLLLGLCLYWLLRRPSGVVLCLLGACFQMLPAAPSGCPQLCRCEGRLLYCEALNLTEA
PHNLSGLLGLSLRYNSLSELRAGQFTGLMQLTWLYLDHNHICSVQGDAFQKLRRVKELTL
SSNQITQLPNTTFRPMPNLRSVDLSYNKLQALAPDLFHGLRKLTTLHMRANAIQFVPVRI
FQDCRSLKFLDIGYNQLKSLARNSFAGLFKLTELHLEHNDLVKVNFAHFPRLISLHSLCL
RRNKVAIVVSSLDWVWNLEKMDLSGNEIEYMEPHVFETVPHLQSLQLDSNRLTYIEPRIL
NSWKSLTSITLAGNLWDCGRNVCALASWLSNFQGRYDGNLQCASPEYAQGEDVLDAVYAF
HLCEDGAEPTSGHLLSAVTNRSDLGPPASSATTLADGGEGQHDGTFEPATVALPGGEHAE
NAVQIHKVVTGTMALIFSFLIVVLVLYVSWKCFPASLRQLRQCFVTQRRKQKQKQTMHQM
AAMSAQEYYVDYKPNHIEGALVIINEYGSCTCHQQPARECEV
```

FIGURE 161

```
GGCCGCCTGGAATTGTGGGAGTTGTGTCTGCCACTCGGCTGCCGGAGGCCGAAGGTCCGT
GACTATGGCTCCCCAGAGCCTGCCTTCATCTAGGATGGCTCCTCTGGGCATGCTGCTTGG
GCTGCTGATGGCCGCCTGCTTCACCTTCTGCCTCAGTCATCAGAACCTGAAGGAGTTTGC
CCTGACCAACCCAGAGAAGAGCAGCACCAAAGAAACGGAGAGAAAAGAAACCAAAGCCGA
GGAGGAGCTGGATGCCGAAGTCCTGGAGGTGTTCCACCCGACGCATGAGTGGCAGGCCCT
TCAGCCAGGGCAGGCTGTCCCTGCAGGATCCACGTACGGCTGAATCTTCAGACTGGGGA
AAGAGAGGCAAAACTCCAATATGAGGACAAGTTCCGAAATAATTTGAAAGGCAAAAGGCT
GGATATCAACACCAACACCTACACATCTCAGGATCTCAAGAGTGCACTGGCAAAATTCAA
GGAGGGGGCAGAGATGGAGAGTTCAAAGGAAGACAAGGCAAGGCAGGCTGAGGTAAAGCG
GCTCTTCCGCCCCATTGAGGAACTGAAGAAAGACTTTGATGAGCTGAATGTTGTCATTGA
GACTGACATGCAGATCATGGTACGGCTGATCAACAAGTTCAATAGTTCCAGCTCCAGTTT
GGAAGAGAAGATTGCTGCGCTCTTTGATCTTGAATATTATGTCCATCAGATGGACAATGC
GCAGGACCTGCTTTCCTTTGGTGGTCTTCAAGTGGTGATCAATGGGCTGAACAGCACAGA
GCCCCTCGTGAAGGAGTATGCTGCGTTTGTGCTGGGCGCTGCCTTTTCCAGCAACCCCAA
GGTCCAGGTGGAGGCCATCGAAGGGGGAGCCCTGCAGAAGCTGCTGGTCATCCTGGCCAC
GGAGCAGCCGCTCACTGCAAAGAAGAAGGTCCTGTTTGCACTGTGCTCCCTGCTGCGCCA
CTTCCCCTATGCCCAGCGGCAGTTCCTGAAGCTCGGGGGGCTGCAGGTCCTGAGGACCCT
GGTGCAGGAGAAGGGCACGGAGGTGCTCGCCGTGCGCGTGGTCACACTGCTCTACGACCT
GGTCACGGAGAAGATGTTCGCCGAGGAGGAGGCTGAGCTGACCCAGGAGATGTCCCCAGA
GAAGCTGCAGCAGTATCGCCAGGTACACCTCCTGCCAGGCCTGTGGGAACAGGGCTGGTG
CGAGATCACGGCCCACCTCCTGGCGCTGCCCGAGCATGATGCCCGTGAGAAGGTGCTGCA
GACACTGGGCGTCCTCCTGACCACCTGCCGGGACCGCTACCGTCAGGACCCCCAGCTCGG
CAGGACACTGGCCAGCCTGCAGGCTGAGTACCAGGTGCTGGCCAGCCTGGAGCTGCAGGA
TGGTGAGGACGAGGGCTACTTCCAGGAGCTGCTGGGCTCTGTCAACAGCTTGCTGAAGGA
GCTGAGATGAGGCCCCACACCAGGACTGGACTGGGATGCCGCTAGTGAGGCTGAGGGGTG
CCAGCGTGGGTGGGCTTCTCAGGCAGGAGGACATCTTGGCAGTGCTGGCTTGGCCATTAA
ATGGAAACCTGAAGGCCAAAAAAAAAAAAAAAAAAAAAAAAAAAAAAAAAAAAAAAAAAA
AAAAAAAAAAAAAAAAAAAAAAAAAAAAAAAAAAAAAAAAAAAAAAAAAAA
```

FIGURE 162

MAPQSLPSSRMAPLGMLLGLLMAACFTFCLSHQNLKEFALTNPEKSSTKETERKETKAEE
ELDAEVLEVFHPTHEWQALQPGQAVPAGSHVRLNLQTGEREAKLQYEDKFRNNLKGKRLD
INTNTYTSQDLKSALAKFKEGAEMESSKEDKARQAEVKRLFRPIEELKKDFDELNVVIET
DMQIMVRLINKFNSSSSSLEEKIAALFDLEYYVHQMDNAQDLLSFGGLQVVINGLNSTEP
LVKEYAAFVLGAAFSSNPKVQVEAIEGGALQKLLVILATEQPLTAKKKVLFALCSLLRHF
PYAQRQFLKLGGLQVLRTLVQEKGTEVLAVRVVTLLYDLVTEKMFAEEEAELTQEMSPEK
LQQYRQVHLLPGLWEQGWCEITAHLLALPEHDAREKVLQTLGVLLTTCRDRYRQDPQLGR
TLASLQAEYQVLASLELQDGEDEGYFQELLGSVNSLLKELR

Important features:
Signal peptide:
amino acids 1-29

Hypothetical YJL126w/YLR351c/yhcX family protein:
amino acids 364-373

N-glycosylation site:
amino acids 193-197, 236-240

N-myristoylation site:
amino acids 15-21, 19-25, 234-240, 251-257, 402-408, 451-457

Homologous region SLS1 protein:
amino acids 68-340

FIGURE 163

CAGAGAGGAGGCTTTGGGAATTGTCCAGCAGAAACAGAGAAGTCTGAGGTGGTGTCAAGA
CAAAAGATGCTTCAGCTTTGGAAACTTGTTCTCCTGTGCGGCGTGCTCACTGGGACCTCA
GAGTCTCTTCTTGACAATCTTGGCAATGACCTAAGCAATGTCGTGGATAAGCTGGAACCT
GTTCTTCACGAGGGACTTGAGACAGTTGACAATACTCTTAAAGGCATCCTTGAGAAACTG
AAGGTCGACCTAGGAGTGCTTCAGAAATCCAGTGCTTGGCAACTGGCCAAGCAGAAGGCC
CAGGAAGCTGAGAAATTGCTGAACAATGTCATTTCTAAGCTGCTTCCAACTAACACGGAC
ATTTTTGGGTTGAAAATCAGCAACTCCCTCATCCTGGATGTCAAAGCTGAACCGATCGAT
GATGGCAAAGGCCTTAACCTGAGCTTCCCTGTCACCGCGAATGTCACTGTGGCCGGGCCC
ATCATTGGCCAGATTATCAACCTGAAAGCCTCCTTGGACCTCCTGACCGCAGTCACAATT
GAAACTGATCCCCAGACACACCAGCCTGTTGCCGTCCTGGGAGAATGCGCCAGTGACCCA
ACCAGCATCTCACTTTCCTTGCTGGACAAACACAGCCAAATCATCAACAAGTTCGTGAAT
AGCGTGATCAACACGCTGAAAAGCACTGTATCCTCCCTGCTGCAGAAGGAGATATGTCCA
CTGATCCGCATCTTCATCCACTCCCTGGATGTGAATGTCATTCAGCAGGTCGTCGATAAT
CCTCAGCACAAAACCCAGCTGCAAACCCTCATCTGAAGAGGACGAATGAGGAGGACCACT
GTGGTGCATGCTGATTGGTTCCCAGTGGCTTGCCCCACCCCCTTATAGCATCTCCCTCCA
GGAAGCTGCTGCCACCACCTAACCAGCGTGAAAGCCTGAGTCCCACCAGAAGGACCTTCC
CAGATACCCCTTCTCCTCACAGTCAGAACAGCAGCCTCTACACATGTTGTCCTGCCCCTG
GCAATAAAGGCCCATTTCTGCACCCTTAA

FIGURE 164

MLQLWKLVLLCGVLTGTSESLLDNLGNDLSNVVDKLEPVLHEGLETVDNTLKGILEKLKV
DLGVLQKSSAWQLAKQKAQEAEKLLNNVISKLLPTNTDIFGLKISNSLILDVKAEPIDDG
KGLNLSFPVTANVTVAGPIIGQIINLKASLDLLTAVTIETDPQTHQPVAVLGECASDPTS
ISLSLLDKHSQIINKFVNSVINTLKSTVSSLLQKEICPLIRIFIHSLDVNVIQQVVDNPQ
HKTQLQTLI

Important features:

Signal peptide:
1-15

Transmembrane domain:
none

N-glycosylation site:
124-128, 132-136

N-myristoylation site:
12-18, 16-22, 26-32, 101-107, 122-128, 141-147

Leucine zipper pattern:
44-66

FIGURE 165

```
GCAGTCAGAGACTTCCCCTGCCCCTCGCTGGGAAAGAACATTAGGAATGCCTTTTAGTGC
CTTGCTTCCTGAACTAGCTCACAGTAGCCCGGCGGCCCAGGGCAATCCGACCACATTTCA
CTCTCACCGCTGTAGGAATCCAGATGCAGGCCAAGTACAGCAGCACGAGGGACATGCTGG
ATGATGATGGGGACACCACCATGAGCCTGCATTCTCAAGCCTCTGCCACAACTCGGCATC
CAGAGCCCCGGCGCACAGAGCACAGGGCTCCCTCTTCAACGTGGCGACCAGTGGCCCTGA
CCCTGCTGACTTTGTGCTTGGTGCTGCTGATAGGGCTGGCAGCCCTGGGGCTTTTGTTTT
TTCAGTACTACCAGCTCTCCAATACTGGTCAAGACACCATTTCTCAAATGGAAGAAAGAT
TAGGAAATACGTCCCAAGAGTTGCAATCTCTTCAAGTCCAGAATATAAAGCTTGCAGGAA
GTCTGCAGCATGTGGCTGAAAAACTCTGTCGTGAGCTGTATAACAAAGCTGGAGCACACA
GGTGCAGCCCTTGTACAGAACAATGGAAATGGCATGGAGACAATTGCTACCAGTTCTATA
AAGACAGCAAAGTTGGGAGGACTGTAAATATTTCTGCCTTAGTGAAAACTCTACCATGC
TGAAGATAAACAAACAAGAAGACCTGGAATTTGCCGCGTCTCAGAGCTACTCTGAGTTTT
TCTACTCTTATTGGACAGGGCTTTTGCGCCCTGACAGTGGCAAGGCCTGGCTGTGGATGG
ATGGAACCCCTTTCACTTCTGAACTGTTCCATATTATAATAGATGTCACCAGCCCAAGAA
GCAGAGACTGTGTGGCCATCCTCAATGGGATGATCTTCTCAAAGGACTGCAAAGAATTGA
AGCGTTGTGTCTGTGAGAGAAGGGCAGGAATGGTGAAGCCAGAGAGCCTCCATGTCCCCC
CTGAAACATTAGGCGAAGGTGACTGATTCGCCCTCTGCAACTACAAATAGCAGAGTGAGC
CAGGCGGTGCCAAAGCAAGGGCTAGTTGAGACATTGGGAAATGGAACATAATCAGGAAAG
ACTATCTCTCTGACTAGTACAAAATGGGTTCTCGTGTTTCCTGTTCAGGATCACCAGCAT
TTCTGAGCTTGGGTTTATGCACGTATTTAACAGTCACAAGAAGTCTTATTTACATGCCAC
CAACCAACCTCAGAAACCCATAATGTCATCTGCCTTCTTGGCTTAGAGATAACTTTTAGC
TCTCTTTCTTCTCAATGTCTAATATCACCTCCCTGTTTTCATGTCTTCCTTACACTTGGT
GGAATAAGAAACTTTTTGAAGTAGAGGAAATACATTGAGGTAACATCCTTTTCTCTGACA
GTCAAGTAGTCCATCAGAAATTGGCAGTCACTTCCCAGATTGTACCAGCAAATACACAAG
GAATTCTTTTTGTTTGTTTCAGTTCATACTAGTCCCTTCCCAATCCATCAGTAAAGACCC
CATCTGCCTTGTCCATGCCGTTTCCCAACAGGGATGTCACTTGATATGAGAATCTCAAAT
CTCAATGCCTTATAAGCATTCCTTCCTGTGTCCATTAAGACTCTGATAATTGTCTCCCCT
CCATAGGAATTTCTCCCAGGAAAGAAATATATCCCCATCTCCGTTTCATATCAGAACTAC
CGTCCCCGATATTCCCTTCAGAGAGATTAAAGACCAGAAAAAGTGAGCCTCTTCATCTG
CACCTGTAATAGTTTCAGTTCCTATTTTCTTCCATTGACCCATATTTATACCTTTCAGGT
ACTGAAGATTTAATAATAATAAATGTAAATACTGTGAAAAA
```

FIGURE 166

MQAKYSSTRDMLDDDGDTTMSLHSQASATTRHPEPRRTEHRAPSSTWRPVALTLLTLCLV
LLIGLAALGLLFFQYYQLSNTGQDTISQMEERLGNTSQELQSLQVQNIKLAGSLQHVAEK
LCRELYNKAGAHRCSPCTEQWKWHGDNCYQFYKDSKSWEDCKYFCLSENSTMLKINKQED
LEFAASQSYSEFFYSYWTGLLRPDSGKAWLWMDGTPFTSELFHIIIDVTSPRSRDCVAIL
NGMIFSKDCKELKRCVCERRAGMVKPESLHVPPETLGEGD

FIGURE 167

GCGACGGGCAGGACGCCCCGTTCGCCTAGCGCGTGCTCAGGAGTTGGTGTCCTGCCTGCG
CTCAGGATGAGGGGGAATCTGGCCCTGGTGGGCGTTCTAATCAGCCTGGCCTTCCTGTCA
CTGCTGCCATCTGGACATCCTCAGCCGGCTGGCGATGACGCCTGCTCTGTGCAGATCCTC
GTCCCTGGCCTCAAAGGGGATGCGGGAGAGAAGGGAGACAAAGGCGCCCCCGGACGGCCT
GGAAGAGTCGGCCCCACGGGAGAAAAAGGAGACATGGGGGACAAAGGACAGAAAGGCAGT
GTGGGTCGTCATGGAAAAATTGGTCCCATTGGCTCTAAAGGTGAGAAAGGAGATTCCGGT
GACATAGGACCCCTGGTCCTAATGGAGAACCAGGCCTCCCATGTGAGTGCAGCCAGCTG
CGCAAGGCCATCGGGGAGATGGACAACCAGGTCTCTCAGCTGACCAGCGAGCTCAAGTTC
ATCAAGAATGCTGTCGCCGGTGTGCGCGAGACGGAGAGCAAGATCTACCTGCTGGTGAAG
GAGGAGAAGCGCTACGCGGACGCCCAGCTGTCCTGCCAGGGCCGCGGGGGCACGCTGAGC
ATGCCCAAGGACGAGGCTGCCAATGGCCTGATGGCCGCATACCTGGCGCAAGCCGGCCTG
GCCCGTGTCTTCATCGGCATCAACGACCTGGAGAAGGAGGGCGCCTTCGTGTACTCTGAC
CACTCCCCCATGCGGACCTTCAACAAGTGGCGCAGCGGTGAGCCCAACAATGCCTACGAC
GAGGAGGACTGCGTGGAGATGGTGGCCTCGGGCGGCTGGAACGACGTGGCCTGCCACACC
ACCATGTACTTCATGTGTGAGTTTGACAAGGAGAACATGTGAGCCTCAGGCTGGGCTGC
CCATTGGGGGCCCCACATGTCCCTGCAGGGTTGGCAGGGACAGAGCCCAGACCATGGTGC
CAGCCAGGGAGCTGTCCCTCTGTGAAGGGTGGAGGCTCACTGAGTAGAGGGCTGTTGTCT
AAACTGAGAAAATGGCCTATGCTTAAGAGGAAAATGAAAGTGTTCCTGGGGTGCTGTCTC
TGAAGAAGCAGAGTTTCATTACCTGTATTGTAGCCCCAATGTCATTATGTAATTATTACC
CAGAATTGCTCTTCCATAAAGCTTGTGCCTTTGTCCAAGCTATACAATAAAATCTTTAAG
TAGTGCAGTAGTTAAGTCCAAAAAAAAAAAAAAAAAAA

FIGURE 168

MRGNLALVGVLISLAFLSLLPSGHPQPAGDDACSVQILVPGLKGDAGEKGDKGAPGRPGR
VGPTGEKGDMGDKGQKGSVGRHGKIGPIGSKGEKGDSGDIGPPGPNGEPGLPCECSQLRK
AIGEMDNQVSQLTSELKFIKNAVAGVRETESKIYLLVKEEKRYADAQLSCQGRGGTLSMP
KDEAANGLMAAYLAQAGLARVFIGINDLEKEGAFVYSDHSPMRTFNKWRSGEPNNAYDEE
DCVEMVASGGWNDVACHTTMYFMCEFDKENM

FIGURE 169

AGTGACTGCAGCCTTCCTAGATCCCCTCCACTCGGTTTCTCTCTTTGCAGGAGCACCGGC
AGCACCAGTGTGTGAGGGGAGCAGGCAGCGGTCCTAGCCAGTTCCTTGATCCTGCCAGAC
CACCCAGCCCCCGGCACAGAGCTGCTCCACAGGCACCATGAGGATCATGCTGCTATTCAC
AGCCATCCTGGCCTTCAGCCTAGCTCAGAGCTTTGGGGCTGTCTGTAAGGAGCCACAGGA
GGAGGTGGTTCCTGGCGGGGGCCGCAGCAAGAGGGATCCAGATCTCTACCAGCTGCTCCA
GAGACTCTTCAAAAGCCACTCATCTCTGGAGGGATTGCTCAAAGCCCTGAGCCAGGCTAG
CACAGATCCTAAGGAATCAACATCTCCCGAGAAACGTGACATGCATGACTTCTTTGTGGG
ACTTATGGGCAAGAGGAGCGTCCAGCCAGAGGGAAAGACAGGACCTTTCTTACCTTCAGT
GAGGGTTCCTCGGCCCCTTCATCCCAATCAGCTTGGATCCACAGGAAAGTCTTCCCTGGG
AACAGAGGAGCAGAGACCTTTATAAGACTCTCCTACGGATGTGAATCAAGAGAACGTCCC
CAGCTTTGGCATCCTCAAGTATCCCCCGAGAGCAGAATAGGTACTCCACTTCCGGACTCC
TGGACTGCATTAGGAAGACCTCTTTCCCTGTCCCAATCCCCAGGTGCGCACGCTCCTGTT
ACCCTTTCTCTTCCCTGTTCTTGTAACATTCTTGTGCTTTGACTCCTTCTCCATCTTTTC
TACCTGACCCTGGTGTGGAAACTGCATAGTGAATATCCCCAACCCCAATGGGCATTGACT
GTAGAATACCCTAGAGTTCCTGTAGTGTCCTACATTAAAAATATAATGTCTCTCTCTATT
CCTCAACAATAAAGGATTTTTGCATATGAAAAAAAAAAAAAAAAAAAAAAAAAAAAAAA
AAAAAAAAAAA

FIGURE 170

MRIMLLFTAILAFSLAQSFGAVCKEPQEEVVPGGGRSKRDPDLYQLLQRLFKSHSSLEGL
LKALSQASTDPKESTSPEKRDMHDFFVGLMGKRSVQPEGKTGPFLPSVRVPRPLHPNQLG
STGKSSLGTEEQRPL

Important features:
Signal peptide:
amino acids 1-18

Tyrosine kinase phosphorylation site:
amino acids 36-45

N-myristoylation site:
amino acids 33-39, 59-65

Amidation site:
amino acids 90-94

Leucine zipper pattern:
amino acids 43-65

Tachykinin family signature:
amino acids 86-92

FIGURE 171

```
TGGCCTCCCCAGCTTGCCAGGCACAAGGCTGAGCGGGAGGAAGCGAGAGGCATCTAAGCA
GGCAGTGTTTTGCCTTCACCCCAAGTGACCATGAGAGGTGCCACGCGAGTCTCAATCATG
CTCCTCCTAGTAACTGTGTCTGACTGTGCTGTGATCACAGGGGCCTGTGAGCGGGATGTC
CAGTGTGGGGCAGGCACCTGCTGTGCCATCAGCCTGTGGCTTCGAGGGCTGCGGATGTGC
ACCCCGCTGGGGCGGGAAGGCGAGGAGTGCCACCCCGGCAGCCACAAGGTCCCCTTCTTC
AGGAAACGCAAGCACCACACCTGTCCTTGCTTGCCCAACCTGCTGTGCTCCAGGTTCCCG
GACGGCAGGTACCGCTGCTCCATGGACTTGAAGAACATCAATTTTTAGGCGCTTGCCTGG
TCTCAGGATACCCACCATCCTTTTCCTGAGCACAGCCTGGATTTTTATTTCTGCCATGAA
ACCCAGCTCCCATGACTCTCCCAGTCCCTACACTGACTACCCTGATCTCTCTTGTCTAGT
ACGCACATATGCACACAGGCAGACATACCTCCCATCATGACATGGTCCCCAGGCTGGCCT
GAGGATGTCACAGCTTGAGGCTGTGGTGTGAAAGGTGGCCAGCCTGGTTCTCTTCCCTGC
TCAGGCTGCCAGAGAGGTGGTAAATGGCAGAAAGGACATTCCCCCTCCCCTCCCCAGGTG
ACCTGCTCTCTTTCCTGGGCCCTGCCCCTCTCCCCACATGTATCCCTCGGTCTGAATTAG
ACATTCCTGGGCACAGGCTCTTGGGTGCATTGCTCAGAGTCCCAGGTCCTGGCCTGACCC
TCAGGCCCTTCACGTGAGGTCTGTGAGGACCAATTTGTGGGTAGTTCATCTTCCCTCGAT
TGGTTAACTCCTTAGTTTCAGACCACAGACTCAAGATTGGCTCTTCCCAGAGGGCAGCAG
ACAGTCACCCCAAGGCAGGTGTAGGGAGCCCAGGGAGGCCAATCAGCCCCTGAAGACTC
TGGTCCCAGTCAGCCTGTGGCTTGTGGCCTGTGACCTGTGACCTTCTGCCAGAATTGTCA
TGCCTCTGAGGCCCCCTCTTACCACACTTTACCAGTTAACCACTGAAGCCCCCAATTCCC
ACAGCTTTTCCATTAAAATGCAAATGGTGGTGGTTCAATCTAATCTGATATTGACATATT
AGAAGGCAATTAGGGTGTTTCCTTAAACAACTCCTTTCCAAGGATCAGCCCTGAGAGCAG
GTTGGTGACTTTGAGGAGGGCAGTCCTCTGTCCAGATTGGGGTGGGAGCAAGGGACAGGG
AGCAGGGCAGGGGCTGAAAGGGGCACTGATTCAGACCAGGGAGGCAACTACACACCAACA
TGCTGGCTTTAGAATAAAAGCACCAACTGAAAAAA
```

FIGURE 172

MRGATRVSIMLLLVTVSDCAVITGACERDVQCGAGTCCAISLWLRGLRMCTPLGREGEEC
HPGSHKVPFFRKRKHHTCPCLPNLLCSRFPDGRYRCSMDLKNINF

Signal peptide:
amino acids 1-19

Tyrosine kinase phosphorylation site:
amino acids 88-95

N-myristoylation sites:
amino acids 33-39, 35-41, 46-52

FIGURE 173

AGCGCCCGGGCGTCGGGGCGGTAAAAGGCCGGCAGAAGGGAGGCACTTGAGAAATGTCTT
TCCTCCAGGACCCAAGTTTCTTCACCATGGGGATGTGGTCCATTGGTGCAGGAGCCCTGG
GGGCTGCTGCCTTGGCATTGCTGCTTGCCAACACAGACGTGTTTCTGTCCAAGCCCCAGA
AAGCGGCCCTGGAGTACCTGGAGGATATAGACCTGAAAACACTGGAGAAGGAACCAAGGA
CTTTCAAAGCAAAGGAGCTATGGGAAAAAAATGGAGCTGTGATTATGGCCGTGCGGAGGC
CAGGCTGTTTCCTCTGTCGAGAGGAAGCTGCGGATCTGTCCTCCCTGAAAAGCATGTTGG
ACCAGCTGGGCGTCCCCCTCTATGCAGTGGTAAAGGAGCACATCAGGACTGAAGTGAAGG
ATTTCCAGCCTTATTTCAAAGGAGAAATCTTCCTGGATGAAAAGAAAAAGTTCTATGGTC
CACAAAGGCGGAAGATGATGTTTATGGGATTTATCCGTCTGGGAGTGTGGTACAACTTCT
TCCGAGCCTGGAACGGAGGCTTCTCTGGAAACCTGGAAGGAGAAGGCTTCATCCTTGGGG
GAGTTTTCGTGGTGGGATCAGGAAAGCAGGGCATTCTTCTTGAGCACCGAGAAAAGAAT
TTGGAGACAAAGTAAACCTACTTTCTGTTCTGGAAGCTGCTAAGATGATCAAACCACAGA
CTTTGGCCTCAGAGAAAAAATGATTGTGTGAAACTGCCCAGCTCAGGGATAACCAGGGAC
ATTCACCTGTGTTCATGGGATGTATTGTTTCCACTCGTGTCCCTAAGGAGTGAGAAACCC
ATTTATACTCTACTCTCAGTATGGATTATTAATGTATTTTAATATTCTGTTTAGGCCCAC
TAAGGCAAAATAGCCCCAAAACAAGACTGACAAAAATCTGAAAAACTAATGAGGATTATT
AAGCTAAAACCTGGGAAATAGGAGGCTTAAAATTGACTGCCAGGCTGGGTGCAGTGGCTC
ACACCTGTAATCCCAGCACTTTGGGAGGCCAAGGTGAGCAAGTCACTTGAGGTCGGGAGT
TCGAGACCAGCCTGAGCAACATGGCGAAACCCCGTCTCTACTAAAAATACAAAAATCACC
CGGGTGTGGTGGCAGGCACCTGTAGTCCCAGCTACCGGGAGGCTGAGGCAGGAGAATCA
CTTGAACCTGGGAGGTGGAGGTTGCGGTGAGCTGAGATCACACCACTGTATTCCAGCCTG
GGTGACTGAGACTCTAACTAA

FIGURE 174

MSFLQDPSFFTMGMWSIGAGALGAAALALLLANTDVFLSKPQKAALEYLEDIDLKTLEKE
PRTFKAKELWEKNGAVIMAVRRPGCFLCREEAADLSSLKSMLDQLGVPLYAVVKEHIRTE
VKDFQPYFKGEIFLDEKKKFYGPQRRKMMFMGFIRLGVWYNFFRAWNGGFSGNLEGEGFI
LGGVFVVGSGKQGILLEHREKEFGDKVNLLSVLEAAKMIKPQTLASEKK

FIGURE 175

GACAGTGGAGGGCAGTGGAGAGGACCGCGCTGTCCTGCTGTCACCAAGAGCTGGAGACAC
CATCTCCCACCGAGAGTCATGGCCCCATTGGCCCTGCACCTCCTCGTCCTCGTCCCCATC
CTCCTCAGCCTGGTGGCCTCCCAGGACTGGAAGGCTGAACGCAGCCAAGACCCCTTCGAG
AAATGCATGCAGGATCCTGACTATGAGCAGCTGCTCAAGGTGGTGACCTGGGGGCTCAAT
CGGACCCTGAAGCCCCAGAGGGTGATTGTGGTTGGCGCTGGTGTGGCCGGGCTGGTGGCC
GCCAAGGTGCTCAGCGATGCTGGACACAAGGTCACCATCCTGGAGGCAGATAACAGGATC
GGGGGCCGCATCTTCACCTACCGGGACCAGAACACGGGCTGGATTGGGGAGCTGGGAGCC
ATGCGCATGCCCAGCTCTCACAGGATCCTCCACAAGCTCTGCCAGGGCCTGGGGCTCAAC
CTGACCAAGTTCACCCAGTACGACAAGAACACGTGGACGGAGGTGCACGAAGTGAAGCTG
CGCAACTATGTGGTGGAGAAGGTGCCCGAGAAGCTGGGCTACGCCTTGCGTCCCCAGGAA
AAGGGCCACTCGCCCGAAGACATCTACCAGATGGCTCTCAACCAGGCCCTCAAAGACCTC
AAGGCACTGGGCTGCAGAAAGGCGATGAAGAAGTTTGAAAGGCACACGCTCTTGGAATAT
CTTCTCGGGGAGGGGAACCTGAGCCGGCCGGCCGTGCAGCTTCTGGGAGACGTGATGTCC
GAGGATGGCTTCTTCTATCTCAGCTTCGCCGAGGCCCTCCGGGCCCACAGCTGCCTCAGC
GACAGACTCCAGTACAGCCGCATCGTGGGTGGCTGGGACCTGCTGCCGCGCGCGCTGCTG
AGCTCGCTGTCCGGGCTTGTGCTGTTGAACGCGCCCGTGGTGGCGATGACCCAGGGACCG
CACGATGTGCACGTGCAGATCGAGACCTCTCCCCCGGCGCGGAATCTGAAGGTGCTGAAG
GCCGACGTGGTGCTGCTGACGGCGAGCGGACCGGCGGTGAAGCGCATCACCTTCTCGCCG
CCGCTGCCCCGCCACATGCAGGAGGCGCTGCGGAGGCTGCACTACGTGCCGGCCACCAAG
GTGTTCCTAAGCTTCCGCAGGCCCTTCTGGCGCGAGGAGCACATTGAAGGCGGCCACTCA
ACACCGATCGCCCGTCGCGCATGATTTTCTACCCGCCGCCGCGCGAGGGCGCGCTGCTG
CTGGCCTCGTACACGTGGTCGGACGCGGCGGCAGCGTTCGCCGGCTTGAGCCGGGAAGAG
GCGTTGCGCTTGGCGCTCGACGACGTGGCGGCATTGCACGGGCCTGTCGTGCGCCAGCTC
TGGGACGGCACCGGCGTCGTCAAGCGTTGGGCGGAGGACCAGCACAGCCAGGGTGGCTTT
GTGGTACAGCCGCCGGCGCTCTGGCAAACCGAAAAGGATGACTGGACGGTCCCTTATGGC
CGCATCTACTTTGCCGGCGAGCACACCGCCTACCCGCACGGCTGGGTGGAGACGGCGGTC
AAGTCGGCGCTGCGCGCCGCCATCAAGATCAACAGCCGGAAGGGGCCTGCATCGGACACG
GCCAGCCCCGAGGGGCACGCATCTGACATGGAGGGGCAGGGGCATGTGCATGGGGTGGCC
AGCAGCCCCTCGCATGACCTGGCAAAGGAAGAAGGCAGCCACCCTCCAGTCCAAGGCCAG
TTATCTCTCCAAAACACGACCCACACGAGGACCTCGCATTAAAGTATTTTCGGAAAAAAA
AAAAAAAAAAAAAAAAAAAAAAAAAAAAAAAAAAAAAAAAA

FIGURE 176

MAPLALHLLVLVPILLSLVASQDWKAERSQDPFEKCMQDPDYEQLLKVVTWGLNRTLKPQ
RVIVVGAGVAGLVAAKVLSDAGHKVTILEADNRIGGRIFTYRDQNTGWIGELGAMRMPSS
HRILHKLCQGLGLNLTKFTQYDKNTWTEVHEVKLRNYVVEKVPEKLGYALRPQEKGHSPE
DIYQMALNQALKDLKALGCRKAMKKFERHTLLEYLLGEGNLSRPAVQLLGDVMSEDGFFY
LSFAEALRAHSCLSDRLQYSRIVGGWDLLPRALLSSLSGLVLLNAPVVAMTQGPHDVHVQ
IETSPPARNLKVLKADVVLLTASGPAVKRITFSPPLPRHMQEALRRLHYVPATKVFLSFR
RPFWREEHIEGGHSNTDRPSRMIFYPPPREGALLLASYTWSDAAAAFAGLSREEALRLAL
DDVAALHGPVVRQLWDGTGVVKRWAEDQHSQGGFVVQPPALWQTEKDDWTVPYGRIYFAG
EHTAYPHGWVETAVKSALRAAIKINSRKGPASDTASPEGHASDMEGQGHVHGVASSPSHD
LAKEEGSHPPVQGQLSLQNTTHTRTSH

Signal peptide:
amino acids 1-21

FIGURE 177

```
CCGGGGAGGGGAGGGCCCGTCCCGCCCCTCCCCGTCTCTCCCCGCCCCTCCCCGTCCCTC
CCGCCGAAGCTCCGTCCCGCCCGCGGGCCGGCTCCGCCCTCACCTCCCGGCCGCGGCTGC
CCTCTGCCCGGGTTGTCCAAGATGGAGGGCGCTCCACCGGGGTCGCTCGCCCTCCGGCTC
CTGCTGTTCGTGGCGCTACCCGCCTCCGGCTGGCTGACGACGGGCGCCCCGAGCCGCCG
CCGCTGTCCGGAGCCCCACAGGACGGCATCAGAATTAATGTAACTACACTGAAAGATGAT
GGGGACATATCTAAACAGCAGGTTGTTCTTAACATAACCTATGAGAGTGGACAGGTGTAT
GTAAATGACTTACCTGTAAATAGTGGTGTAACCCGAATAAGCTGTCAGACTTTGATAGTG
AAGAATGAAAATCTTGAAAATTTGGAGGAAAAGAATATTTTGGAATTGTCAGTGTAAGG
ATTTTAGTTCATGAGTGGCCTATGACATCTGGTTCCAGTTTGCAACTAATTGTCATTCAA
GAAGAGGTAGTAGAGATTGATGGAAAACAAGTTCAGCAAAAGGATGTCACTGAAATTGAT
ATTTTAGTTAAGAACCGGGGAGTACTCAGACATTCAAACTATACCCTCCCTTTGGAAGAA
AGCATGCTCTACTCTATTTCTCGAGACAGTGACATTTTATTTACCCTTCCTAACCTCTCC
AAAAAAGAAAGTGTTAGTTCACTGCAAACCACTAGCCAGTATCTTATCAGGAATGTGGAA
ACCACTGTAGATGAAGATGTTTTACCTGGCAAGTTACCTGAAACTCCTCTCAGAGCAGAG
CCGCCATCTTCATATAAGGTAATGTGTCAGTGGATGGAAAAGTTTAGAAAGATCTGTGT
AGGTTCTGGAGCAACGTTTTCCCAGTATTCTTTCAGTTTTTGAACATCATGGTGGTTGGA
ATTACAGGAGCAGCTGTGGTAATAACCATCTTAAAGGTGTTTTTCCCAGTTTCTGAATAC
AAAGGAATTCTTCAGTTGGATAAAGTGGACGTCATACCTGTGACAGCTATCAACTTATAT
CCAGATGGTCCAGAGAAAAGAGCTGAAAACCTTGAAGATAAAACATGTATTTAAAACGCC
ATCTCATATCATGGACTCCGAAGTAGCCTGTTGCCTCCAAATTTGCCACTTGAATATAAT
TTTCTTTAAATCGTT
```

FIGURE 178

MEGAPPGSLALRLLLFVALPASGWLTTGAPEPPPLSGAPQDGIRINVTTLKDDGDISKQQ
VVLNITYESGQVYVNDLPVNSGVTRISCQTLIVKNENLENLEEKEYFGIVSVRILVHEWP
MTSGSSLQLIVIQEEVVEIDGKQVQQKDVTEIDILVKNRGVLRHSNYTLPLEESMLYSIS
RDSDILFTLPNLSKKESVSSLQTTSQYLIRNVETTVDEDVLPGKLPETPLRAEPPSSYKV
MCQWMEKFRKDLCRFWSNVFPVFFQFLNIMVVGITGAAVVITILKVFFPVSEYKGILQLD
KVDVIPVTAINLYPDGPEKRAENLEDKTCI

Signal peptide:
1-23

Transmembrane domain:
266-284

Leucine zipper pattern:
155-177

N-glycosylation site:
46-50, 64-68, 166-170, 191-195

Motif name: N-myristoylation site:
3-9, 42-48, 273-279

FIGURE 179

```
CTCCTTAGGTGGAAACCCTGGGAGTAGAGTACTGACAGCAAAGACCGGGAAAGACCATAC
GTCCCCGGGCAGGGGTGACAACAGGTGTCATCTTTTTGATCTCGTGTGTGGCTGCCTTCC
TATTTCAAGGAAAGACGCCAAGGTAATTTTGACCCAGAGGAGCAATGATGTAGCCACCTC
CTAACCTTCCCTTCTTGAACCCCCAGTTATGCCAGGATTTACTAGAGAGTGTCAACTCAA
CCAGCAAGCGGCTCCTTCGGCTTAACTTGTGGTTGGAGGAGAGAACCTTTGTGGGCTGC
GTTCTCTTAGCAGTGCTCAGAAGTGACTTGCCTGAGGGTGGACCAGAAGAAAGGAAAGGT
CCCCTCTTGCTGTTGGCTGCACATCAGGAAGGCTGTGATGGGAATGAAGGTGAAAACTTG
GAGATTTCACTTCAGTCATTGCTTCTGCCTGCAAGATCATCCTTTAAAAGTAGAGAAGCT
GCTCTGTGTGGTGGTTAACTCCAAGAGGCAGAACTCGTTCTAGAAGGAAATGGATGCAAG
CAGCTCCGGGGGCCCCAAACGCATGCTTCCTGTGGTCTAGCCCAGGGAAGCCCTTCCGTG
GGGGCCCCGGCTTTGAGGGATGCCACCGGTTCTGGACGCATGGCTGATTCCTGAATGATG
ATGGTTCGCCGGGGCTGCTTGCGTGGATTTCCCGGGTGGTGGTTTTGCTGGTGCTCCTC
TGCTGTGCTATCTCTGTCCTGTACATGTTGGCCTGCACCCCAAAAGGTGACGAGGAGCAG
CTGGCACTGCCCAGGGCCAACAGCCCCACGGGGAAGGAGGGGTACCAGGCCGTCCTTCAG
GAGTGGGAGGAGCAGCACCGCAACTACGTGAGCAGCCTGAAGCGGCAGATCGCACAGCTC
AAGGAGGAGCTGCAGGAGAGGAGTGAGCAGCTCAGGAATGGGCAGTACCAAGCCAGCGAT
GCTGCTGGCCTGGGTCTGGACAGGAGCCCCCAGAGAAAACCCAGGCCGACCTCCTGGCC
TTCCTGCACTCGCAGGTGGACAAGGCAGAGGTGAATGCTGGCGTCAAGCTGGCCACAGAG
TATGCAGCAGTGCCTTTCGATAGCTTTACTCTACAGAAGGTGTACCAGCTGGAGACTGGC
CTTACCCGCCACCCCGAGGAGAAGCCTGTGAGGAAGGACAAGCGGGATGAGTTGGTGGAA
GCCATTGAATCAGCCTTGGAGACCCTGAACAATCCTGCAGAGAACAGCCCCAATCACCGT
CCTTACACGGCCTCTGATTTCATAGAAGGGATCTACCGAACAGAAAGGGACAAAGGGACA
TTGTATGAGCTCACCTTCAAAGGGGACCACAAACACGAATTCAAACGGCTCATCTTATTT
CGACCATTCAGCCCCATCATGAAAGTGAAAAATGAAAAGCTCAACATGGCCAACACGCTT
ATCAATGTTATCGTGCCTCTAGCAAAAAGGGTGGACAAGTTCCGGCAGTTCATGCAGAAT
TCAGGGAGATGTGCATTGAGCAGGATGGGAGAGTCCATCTCACTGTTGTTTACTTTGGG
AAAGAAGAAATAAATGAAGTCAAAGGAATACTTGAAAACACTTCCAAAGCTGCCAACTTC
AGGAACTTTACCTTCATCCAGCTGAATGGAGAATTTTCTCGGGGAAAGGGACTTGATGTT
GGAGCCCGCTTCTGGAAGGGAAGCAACGTCCTTCTCTTTTTCTGTGATGTGGACATCTAC
TTCACATCTGAATTCCTCAATACGTGTAGGCTGAATACACAGCCAGGGAAGAAGGTATTT
TATCCAGTTCTTTTCAGTCAGTACAATCCTGGCATAATATACGGCCACCATGATGCAGTC
CCTCCCTTGGAACAGCAGCTGGTCATAAAGAAGGAAACTGGATTTTGGAGAGACTTTGGA
TTTGGGATGACGTGTCAGTATCGGTCAGACTTCATCAATATAGGTGGGTTTGATCTGGAC
ATCAAAGGCTGGGGCGGAGAGGATGTGCACCTTTATCGCAAGTATCTCCACAGCAACCTC
ATAGTGGTACGGACGCCTGTGCGAGGACTCTTCCACCTCTGGCATGAGAAGCGCTGCATG
GACGAGCTGACCCCCGAGCAGTACAAGATGTGCATGCAGTCCAAGGCCATGAACGAGGCA
TCCCACGGCCAGCTGGGCATGCTGGTGTTCAGGCACGAGATAGAGGCTCACCTTCGCAAA
CAGAAACAGAAGACAAGTAGCAAAAAAACATGAACTCCCAGAGAAGGATTGTGGGAGACA
CTTTTTCTTTCCTTTTGCAATTACTGAAAGTGGCTGCAACAGAGAAAGACTTCCATAAA
GGACGACAAAGAATTGGACTGATGGGTCAGAGATGAGAAAGCCTCCGATTTCTCTCTGT
TGGGCTTTTTACAACAGAAATCAAAATCTCCGCTTTGCCTGCAAAAGTAACCCAGTTGCA
CCCTGTGAAGTGTCTGACAAAGGCAGAATGCTTGTGAGATTATAAGCCTAATGGTGTGGA
GGTTTTGATGGTGTTTACAATACACTGAGACCTGTTGTTTTGTGTGCTCATTGAAATATT
CATGATTTAAGAGCAGTTTTGTAAAAAATTCATTAGCATGAAAGGCAAGCATATTCTCC
TCATATGAATGAGCCTATCAGCAGGGCTCTAGTTTCTAGGAATGCTAAAATATCAGAAGG
CAGGAGAGGAGATAGGCTTATTATGATACTAGTGAGTACATTAAGTAAAATAAAATGGAC
CAGAAAAGAAAAGAAACCATAAATATCGTGTCATATTTTCCCCAAGATTAACCAAAAATA
```

FIGURE 179
(continued)

```
ATCTGCTTATCTTTTTGGTTGTCCTTTTAACTGTCTCCGTTTTTTTCTTTTATTTAAAAA
TGCACTTTTTTTCCCTTGTGAGTTATAGTCTGCTTATTTAATTACCACTTTGCAAGCCTT
ACAAGAGAGCACAAGTTGGCCTACATTTTTATATTTTTAAGAAGATACTTTGAGATGCA
TTATGAACTTTCAGTTCAAAGCATCAAATTGATGCCATATCCAAGGACATGCCAAATG
CTGATTCTGTCAGGCACTGAATGTCAGGCATTGAGACATAGGGAAGGAATGGTTTGTACT
AATACAGACGTACAGATACTTTCTCTGAAGAGTATTTTCGAAGAGGAGCAACTGAACACT
GGAGGAAAAGAAAATGACACTTTCTGCTTTACAGAAAAGGAAACTCATTCAGACTGGTGA
TATCGTGATGTACCTAAAAGTCAGAAACCACATTTTCTCCTCAGAAGTAGGGACCGCTTT
CTTACCTGTTTAAATAAACCAAAGTATACCGTGTGAACCAAACAATCTCTTTTCAAAACA
GGGTGCTCCTCCTGGCTTCTGGCTTCCATAAGAAGAAATGGAGAAAAATATATATATATA
TATATATATTGTGAAAGATCAATCCATCTGCCAGAATCTAGTGGGATGGAAGTTTTTGCT
ACATGTTATCCACCCCAGGCCAGGTGGAAGTAACTGAATTATTTTTAAATTAAGCAGTT
CTACTCAATCACCAAGATGCTTCTGAAAATTGCATTTTATTACCATTTCAAACTATTTTT
TAAAAATAAATACAGTTAACATAGAGTGGTTTCTTCATTCATGTGAAAATTATTAGCCAG
CACCAGATGCATGAGCTAATTATCTCTTTGAGTCCTTGCTTCTGTTTGCTCACAGTAAAC
TCATTGTTTAAAAGCTTCAAGAACATTCAAGCTGTTGGTGTGTTAAAAAATGCATTGTAT
TGATTTGTACTGGTAGTTTATGAAATTTAATTAAAACACAGGCCATGAATGGAAGGTGGT
ATTGCACAGCTAATAAAATATGATTTGTGGATATGAA
```

FIGURE 180

MMMVRRGLLAWISRVVVLLVLLCCAISVLYMLACTPKGDEEQLALPRANSPTGKEGYQAV
LQEWEEQHRNYVSSLKRQIAQLKEELQERSEQLRNGQYQASDAAGLGLDRSPPEKTQADL
LAFLHSQVDKAEVNAGVKLATEYAAVPFDSFTLQKVYQLETGLTRHPEEKPVRKDKRDEL
VEAIESALETLNNPAENSPNHRPYTASDFIEGIYRTERDKGTLYELTFKGDHKHEFKRLI
LFRPFSPIMKVKNEKLNMANTLINVIVPLAKRVDKFRQFMQNFREMCIEQDGRVHLTVVY
FGKEEINEVKGILENTSKAANFRNFTFIQLNGEFSRGKGLDVGARFWKGSNVLLFFCDVD
IYFTSEFLNTCRLNTQPGKKVFYPVLFSQYNPGIIYGHHDAVPPLEQQLVIKKETGFWRD
FGFGMTCQYRSDFINIGGFDLDIKGWGGEDVHLYRKYLHSNLIVVRTPVRGLFHLWHEKR
CMDELTPEQYKMCMQSKAMNEASHGQLGMLVFRHEIEAHLRKQKQKTSSKKT

FIGURE 181

```
CGTCTCTGCGTTCGCCATGCGTCCCGGGGCGCCAGGGCCACTCTGGCCTCTGCCCTGGGG
GGCCCTGGCTTGGGCCGTGGGCTTCGTGAGCTCCATGGGCTCGGGGAACCCCGCGCCCGG
TGGTGTTTGCTGGCTCCAGCAGGGCCAGGAGGCCACCTGCAGCCTGGTGCTCCAGACTGA
TGTCACCCGGGCCGAGTGCTGTGCCTCCGGCAACATTGACACCGCCTGGTCCAACCTCAC
CCACCCGGGGAACAAGATCAACCTCCTCGGCTTCTTGGGCCTTGTCCACTGCCTTCCCTG
CAAAGATTCGTGCGACGGCGTGGAGTGCGGCCCGGGCAAGGCGTGCCGCATGCTGGGGGG
CCGCCCGCGCTGCGAGTGCGCGCCCGACTGCTCGGGGCTCCCGGCGCGGCTGCAGGTCTG
CGGCTCAGACGGCGCCACCTACCGCGACGAGTGCGAGCTGCGCGCCGCGCGCTGCCGCGG
CCACCCGGACCTGAGCGTCATGTACCGGGCCGCTGCCGCAAGTCCTGTGAGCACGTGGT
GTGCCCGCGGCCACAGTCGTGCGTCGTGGACCAGACGGGCAGCGCCCACTGCGTGGTGTG
TCGAGCGGCGCCCTGCCCTGTGCCCTCCAGCCCCGGCCAGGAGCTTTGCGGCAACAACAA
CGTCACCTACATCTCCTCGTGCCACATGCGCCAGGCCACCTGCTTCCTGGGCCGCTCCAT
CGGCGTGCGCCACGCGGGCAGCTGCGCAGGCACCCCTGAGGAGCCGCCAGGTGGTGAGTC
TGCAGAAGAGGAAGAGAACTTCGTGTGACCTGCAGGACAGGCCTGGGCCTGGTGCCCGA
GGCCCCCCATCATCCCCTGTTATTTATTGCCACAGCAGAGTCTAATTTATATGCCACGGA
CACTCCTTAGAGCCCGGATTCGGACCACTTGGGGATCCCAGAACCTCCTGACGATATCC
TGGAAGGACTGAGGAAGGGAGGCCTGGGGCCGGCTGGTGGGTGGGATAGACCTGCGTTC
CGGACACTGAGCGCCTGATTTAGGGCCCTTCTCTAGGATGCCCCAGCCCCTACCCTAAGA
CCTATTGCCGGGGAGGATTCCACACTTCCGCTCCTTTGGGGATAAACCTATTAATTATTG
CTACTATCAAGAGGGCTGGGCATTCTCTGCTGGTAATTCCTGAAGAGGCATGACTGCTTT
TCTCAGCCCCAAGCCTCTAGTCTGGGTGTGTACGGAGGGTCTAGCCTGGGTGTGTACGGA
GGGTCTAGCCTGGGTGAGTACGGAGGGTCTAGCCTGGGTGAGTACGGAGGGTCTAGCCTG
GGTGAGTACGGAGGGTCTAGCCTGGGTGTGTATGGAGGATCTAGCCTGGGTGAGTATGGA
GGGTCTAGCCTGGGTGAGTATGGAGGGTCTAGCCTGGGTGTGTATGGAGGGTCTAGCCTG
GGTGAGTATGGAGGGTCTAGCCTGGGTGTGTATGGAGGGTCTAGCCTGGGTGAGTATGGA
GGGTCTAGCCTGGGTGTGTACGGAGGGTCTAGTCTGAGTGCGTGTGGGGACCTCAGAACA
CTGTGACCTTAGCCCAGCAAGCCAGGCCCTTCATGAAGGCAAGAAGGCTGCCACCATTC
CCTGCCAGCCCAAGAACTCCAGCTTCCCCACTGCCTCTGTGTGCCCCTTTGCGTCCTGTG
AAGGCCATTGAGAAATGCCCAGTGTGCCCCCTGGGAAAGGGCACGGCCTGTGCTCCTGAC
ACGGGCTGTGCTTGGCCACAGAACCACCCAGCGTCTCCCCTGCTGCTGTCCACGTCAGTT
CATGAGGCAACGTCGCGTGGTCTCAGACGTGGAGCAGCCAGCGGCAGCTCAGAGCAGGGC
ACTGTGTCCGGCGGAGCCAAGTCCACTCTGGGGAGCTCTGGCGGGACCACGGGCCACT
GCTCACCCACTGGCCCCGAGGGGGTGTAGACGCCAAGACTCACGCATGTGTGACATCCG
GAGTCCTGGAGCCGGGTGTCCCAGTGGCACCACTAGGTGCCTGCTGCCTCCACAGTGGGG
TTCACACCCAGGGCTCCTTGGTCCCCCACAACCTGCCCCGGCCAGGCCTGCAGACCCAGA
CTCCAGCCAGACCTGCCTCACCCACCAATGCAGCCGGGCTGGCGACACCAGCCAGGTGC
TGGTCTTGGGCCAGTTCTCCCACGACGGCTCACCCTCCCCTCCATCTGCGTTGATGCTCA
GAATCGCCTACCTGTGCCTGCGTGTAAACCACAGCCTCAGACCAGCTATGGGGAGAGGAC
AACACGGAGGATATCCAGCTTCCCGGTCTGGGGTGAGGAATGTGGGGAGCTTGGGCATC
CTCCTCCAGCCTCCTCCAGCCCCCAGGCAGTGCCTTACCTGTGGTGCCCAGAAAAGTGCC
CCTAGGTTGGTGGGTCTACAGGAGCCTCAGCCAGGCAGCCCACCCCACCCTGGGGCCCTG
CCTCACCAAGGAAATAAAGACTCAAGCCATAAAAAAAA
```

FIGURE 182

MRPGAPGPLWPLPWGALAWAVGFVSSMGSGNPAPGGVCWLQQGQEATCSLVLQTDVTRAE
CCASGNIDTAWSNLTHPGNKINLLGFLGLVHCLPCKDSCDGVECGPGKACRMLGGRPRCE
CAPDCSGLPARLQVCGSDGATYRDECELRAARCRGHPDLSVMYRGRCRKSCEHVVCPRPQ
SCVVDQTGSAHCVVCRAAPCPVPSSPGQELCGNNNVTYISSCHMRQATCFLGRSIGVRHA
GSCAGTPEEPPGGESAEEEENFV

Important features:
Signal peptide:
amino acids 1-20

N-glycosylation sites:
amino acids 73-77, 215-219

Osteonectin domain proteins:
amino acids 97-130, 169-202

FIGURE 183

```
CACTCATTCATTCCAAAGGGTCTCTCAAGGCAATGGTAATGTGCAAGGAGGTGATACCTA
AATGAATGACCAAAAGAACATGCTTCTGCTTTTGTGTGTCTCCTACATTTTAGACATTTG
TTTGTTTCTCTTGGTAGCCTTTAAATTCCTTGAAGCCCAGGACCATGTCTCACTTACCTT
TGTGTTTCCACTAACTAGTCTACCTCCTGGAATTGGCAGATACTCAGTGAAAGCCTGTGA
ATAAGTGATGTCTATTTCTAGCATATTATTCTGAGATTTAATGATAGATTTAGTGATTG
AATGAGATTTCCATTTTCAAATACAGCAAAAGCATAACTATTTTCATTCATTCATATTCA
TTCAACTTCATTCTCAAAATTAGGTCCTGAGTTAACTAATAATTACCTTTGAAATGTGTG
GGTTATTTGAGGCAATCAGGTGGTGACATTGAGCTCTCAGCCAGAGTTTGTTTCTGGAAT
TGATTCAGTTCCATTGCATTGATTTTGTTCTCAGAAGCCAAGGTTTCCCATGAAAAATC
ATTCCCACTTGAATTGGGCTGTGATTCTTGCTGCGTTTAAGTAAAGGAAGCCTCTTGGTT
CTAGTTCTGCAAACTTACACACTGAACTGGGACAAGTTTTTGTTTAGAGTAATGGCTGGG
AAAAGAGGAACCTTTCATTTTATTCAGAAGTCAAAAACAAAGGCCTCCCAGCCACCTGGA
GATGTTTTGTTGCAGACACCAGCCTGGCTCTGTCTTTATGCCTAACAATTGAGCATCCAG
TCTTCTTTGTGCTGGGACCATTGCTCAGCTCTGCAAGGGGAAAAGAGGGAGAAAGCCAGA
GCTGCCAGGCTTCTTGCACTGGGGCCGGGGAGGGTTCCTGGGAAGCAGGTGCTCTCTGG
CTTCTTGGTACGTGAGGCTCTCGGAGCTGCCTCTCCTCTGACCCTCAGGTCCTCACCGAG
TTTGCTCCAGGAGTATATTGAAAACATACCCAGTGCTCTCTCAAGCACCCACTGCTTAGA
GGGCCCAGATTTCTTTTCCTTCTTTCCCTTGCAGAGCTGGAGACTGCATCGGGCATCTGG
TGTTTAAACTAAACAGGAAAACTGACTAAAGGTCCACAGTGCTCATTGTGTAGACTAGCT
GCCCTCCGATGGGTGCTCTGATTATCAGTGGTTCCAGTGCAGGGCCTGTCACTAAACAGG
CCTCACTTCCTCCTTGGGGGCTTTCCCATGGGAGGTGTGGCTTTTTACTCTACATGGAAA
TGACTCTCTGCAGCCACAGAACACAGTCATTTTCTGAATTATCCCAGTCTCTCATGCGCC
CTGGATTCCTCCAGATGCCTTATATCTCTTGTGCAAAGTTGTCTAAAATTTGGTTCCCAG
CTTCCAAGCCTTGCCTTTTGGCCTTCCTGGAAGTATTTTTGTTGATGAGTCGTCTGTCAT
TATTCTCTAAAATGATTTGCTTTTTGTTTCTTTCATTCCTATTTCCACCCCACATATACA
CACATGCTTCTTAACTTAGGGGATTACATGCCAATAAATCTATTGTTGAAAATGCACTAA
TACTATCGCAAAGACGAAAATTCACAGGCTGAACCGTTGTAAGTCCATATGCTCCTCAAC
TTACATGTGTGATGGAGTTATGCCCAAATAAGTCCATCGTCAAGTTGAAAAATCAAAATC
AAGCCATCTTAGGTTGAGGACCATTTGTTTGTACCTCCAAAGATGTCATATCTTTAAACA
TACTCCCTAGCTTTTCTTTTTACTTTTTATTTTGAAGTAATTATAGAATCACAGAAAGTT
GCAAAAAA
```

FIGURE 184

MGALIISGSSAGPVTKQASLPPWGLSHGRCGFLLYMEMTLCSHRTQSFSELSQSLMRPGF
LQMPYISCAKLSKIWFPASKPCLLAFLEVFLLMSRLSLFSKMICFLFLSFLFPPHIYTHAS

Important features of the protein:
Signal peptide:
amino acids 1-41

Transmembrane domain:
amino acids 88-107

Casein kinase II phosphorylation site:
amino acids 47-50

N-myristoylation site:
amino acids 24-29

FIGURE 185

AACTCAAACTCCTCTCTCTGGGAAAACGCGGTGCTTGCTCCTCCCGGAGTGGCCTTGGCA
GGGTGTTGGAGCCCTCGGTCTGCCCCGTCCGGTCTCTGGGGCCAAGGCTGGGTTTCCCTC
ATGTATGGCAAGAGCTCTACTCGTGCGGTGCTTCTTCTCCTTGGCATACAGCTCACAGCT
CTTTGGCCTATAGCAGCTGTGGAAATTTATACCTCCCGGGTGCTGGAGGCTGTTAATGGG
ACAGATGCTCGGTTAAAATGCACTTTCTCCAGCTTTGCCCCTGTGGGTGATGCTCTAACA
GTGACCTGGAATTTTCGTCCTCTAGACGGGGGACCTGAGCAGTTTGTATTCTACTACCAC
ATAGATCCCTTCCAACCCATGAGTGGGCGGTTTAAGGACCGGGTGTCTTGGGATGGGAAT
CCTGAGCGGTACGATGCCTCCATCCTTCTCTGGAAACTGCAGTTCGACGACAATGGGACA
TACACCTGCCAGGTGAAGAACCCACCTGATGTTGATGGGGTGATAGGGGAGATCCGGCTC
AGCGTCGTGCACACTGTACGCTTCTCTGAGATCCACTTCCTGGCTCTGGCCATTGGCTCT
GCCTGTGCACTGATGATCATAATAGTAATTGTAGTGGTCCTCTTCCAGCATTACCGGAAA
AAGCGATGGGCCGAAAGAGCTCATAAAGTGGTGGAGATAAAATCAAAAGAAGAGGAAAGG
CTCAACCAAGAGAAAAAGGTCTCTGTTTATTTAGAAGACACAGACTAACAATTTTAGATG
GAAGCTGAGATGATTTCCAAGAACAAGAACCCTAGTATTTCTTGAAGTTAATGGAAACTT
TTCTTTGGCTTTTCCAGTTGTGACCCGTTTTCCAACCAGTTCTGCAGCATATTAGATTCT
AGACAAGCAACACCCCTCTGGAGCCAGCACAGTGCTCCTCCATATCACCAGTCATACACA
GCCTCATTATTAAGGTCTTATTTAATTTCAGAGTGTAAATTTTTTCAAGTGCTCATTAGG
TTTTATAAACAAGAAGCTACATTTTTGCCCTTAAGACACTACTTACAGTGTTATGACTTG
TATACACATATATTGGTATCAAAGGGGATAAAAGCCAATTTGTCTGTTACATTTCCTTTC
ACGTATTTCTTTTAGCAGCACTTCTGCTACTAAAGTTAATGTGTTTACTCTCTTTCCTTC
CCACATTCTCAATTAAAAGGTGAGCTAAGCCTCCTCGGTGTTTCTGATTAACAGTAAATC
CTAAATTCAAACTGTTAAATGACATTTTTATTTTTATGTCTCTCCTTAACTATGAGACAC
ATCTTGTTTTACTGAATTTCTTTCAATATTCCAGGTGATAGATTTTTGTCG

FIGURE 186

MYGKSSTRAVLLLLGIQLTALWPIAAVEIYTSRVLEAVNGTDARLKCTFSSFAPVGDALT
VTWNFRPLDGGPEQFVFYYHIDPFQPMSGRFKDRVSWDGNPERYDASILLWKLQFDDNGT
YTCQVKNPPDVDGVIGEIRLSVVHTVRFSEIHFLALAIGSACALMIIIVIVVVLFQHYRK
KRWAERAHKVVEIKSKEEERLNQEKKVSVYLEDTD

FIGURE 187

GCATTTTTGTCTGTGCTCCCTGATCTTCAGGTCACCACCATGAAGTTCTTAGCAGTCCTG
GTACTCTTGGGAGTTTCCATCTTTCTGGTCTCTGCCCAGAATCCGACAACAGCTGCTCCA
GCTGACACGTATCCAGCTACTGGTCCTGCTGATGATGAAGCCCCTGATGCTGAAACCACT
GCTGCTGCAACCACTGCGACCACTGCTGCTCCTACCACTGCAACCACCGCTGCTTCTACC
ACTGCTCGTAAAGACATTCCAGTTTTACCCAAATGGGTTGGGGATCTCCCGAATGGTAGA
GTGTGTCCCTGAGATGGAATCAGCTTGAGTCTTCTGCAATTGGTCACAACTATTCATGCT
TCCTGTGATTTCATCCAACTACTTACCTTGCCTACGATATCCCCTTTATCTCTAATCAGT
TTATTTTCTTTCAAATAAAAAATAACTATGAGCAACATAAAAAAAAAAAAA

FIGURE 188

MKFLAVLVLLGVSIFLVSAQNPTTAAPADTYPATGPADDEAPDAETTAAATTATTAAPTT
ATTAASTTARKDIPVLPKWVGDLPNGRVCP

FIGURE 189

```
GAGCGAACATGGCAGCGCGTTGGCGGTTTTGGTGTGTCTCTGTGACCATGGTGGTGGCGC
TGCTCATCGTTTGCGACGTTCCCTCAGCCTCTGCCCAAAGAAGAAGGAGATGGTGTTAT
CTGAAAAGGTTAGTCAGCTGATGGAATGGACTAACAAAAGACCTGTAATAAGAATGAATG
GAGACAAGTTCCGTCGCCTTGTGAAAGCCCCACCGAGAAATTACTCCGTTATCGTCATGT
TCACTGCTCTCCAACTGCATAGACAGTGTGTCGTTTGCAAGCAAGCTGATGAAGAATTCC
AGATCCTGGCAAACTCCTGGCGATACTCCAGTGCATTCACCAACAGGATATTTTTTGCCA
TGGTGGATTTTGATGAAGGCTCTGATGTATTTCAGATGCTAAACATGAATTCAGCTCCAA
CTTTCATCAACTTTCCTGCAAAAGGGAAACCCAAACGGGGTGATACATATGAGTTACAGG
TGCGGGGTTTTTCAGCTGAGCAGATTGCCCGGTGGATCGCCGACAGAACTGATGTCAATA
TTAGAGTGATTAGACCCCAAATTATGCTGGTCCCCTTATGTTGGGATTGCTTTTGGCTG
TTATTGGTGGACTTGTGTATCTTCGAAGAAGTAATATGGAATTTCTCTTTAATAAAACTG
GATGGGCTTTTGCAGCTTTGTGTTTTGTGCTTGCTATGACATCTGGTCAAATGTGGAACC
ATATAAGAGGACCACCATATGCCCATAAGAATCCCCACACGGGACATGTGAATTATATCC
ATGGAAGCAGTCAAGCCCAGTTTGTAGCTGAAACACACATTGTTCTTCTGTTTAATGGTG
GAGTTACCTTAGGAATGGTGCTTTTATGTGAAGCTGCTACCTCTGACATGGATATTGGAA
AGCGAAAGATAATGTGTGTGGCTGGTATTGGACTTGTTGTATTATTCTTCAGTTGGATGC
TCTCTATTTTAGATCTAAATATCATGGCTACCCATACAGCTTTCTGATGAGTTAAAAAG
GTCCCAGAGATATATAGACACTGGAGTACTGGAAATTGAAAACGAAATCGTGTGTGTT
TGAAAAGAAGAATGCAACTTGTATATTTGTATTACCTCTTTTTTTCAAGTGATTTAAAT
AGTTAATCATTTAACCAAAGAAGATGTGTAGTGCCTTAACAAGCAATCCTCTGTCAAAAT
CTGAGGTATTTGAAATAATTATCCTCTTAACCTTCTCTTCCCAGTGAACTTTATGGAAC
ATTTAATTTAGTACAATTAAGTATATTATAAAAATTGTAAAACTACTACTTTGTTTTAGT
TAGAACAAAGCTCAAAACTACTTTAGTTAACTTGGTCATCTGATTTTATATTGCCTTATC
CAAAGATGGGGAAAGTAAGTCCTGACCAGGTGTTCCCACATATGCCTGTTACAGATAACT
ACATTAGGAATTCATTCTTAGCTTCTTCATCTTTGTGTGGATGTGTATACTTTACGCATC
TTTCCTTTTGAGTAGAGAAATTATGTGTGTCATGTGGTCTTCTGAAAATGGAACACCATT
CTTCAGAGCACACGTCTAGCCCTCAGCAAGACAGTTGTTTCCTCCTCCTTGCATATTT
CCTACTGCGCTCCAGCCTGAGTGATAGAGTGAGACTCTGTCTCAAAAAAAGTATCTCTA
AATACAGGATTATAATTTCTGCTTGAGTATGGTGTTAACTACCTTGTATTTAGAAAGATT
TCAGATTCATTCCATCTCCTTAGTTTTCTTTTAAGGTGACCCATCTGTGATAAAAATATA
GCTTAGTGCTAAAATCAGTGTAACTTATACATGGCCTAAAATGTTTCTACAAATTAGAGT
TTGTCACTTATTCCATTTGTACCTAAGAGAAAAATAGGCTCAGTTAGAAAAGGACTCCCT
GGCCAGGCGCAGTGACTTACGCCTGTAATCTCAGCACTTTGGGAGGCCAAGGCAGGCAGA
TCACGAGGTCAGGAGTTCGAGACCATCCTGGCCAACATGGTGAAACCCCGTCTCTACTAA
AAATATAAAAATTAGCTGGGTGTGGTGGCAGGAGCCTGTAATCCCAGCTACACAGGAGGC
TGAGGCACGAGAATCACTTGAACTCAGGAGATGGAGGTTTCAGTGAGCCGAGATCACGCC
ACTGCACTCCAGCCTGGCAACAGAGCGAGACTCCATCTCAAAAAAAAAAAAAA
```

FIGURE 190

MAARWRFWCVSVTMVVALLIVCDVPSASAQRKKEMVLSEKVSQLMEWTNKRPVIRMNGDK
FRRLVKAPPRNYSVIVMFTALQLHRQCVVCKQADEEFQILANSWRYSSAFTNRIFFAMVD
FDEGSDVFQMLNMNSAPTFINFPAKGKPKRGDTYELQVRGFSAEQIARWIADRTDVNIRV
IRPPNYAGPLMLGLLLAVIGGLVYLRRSNMEFLFNKTGWAFAALCFVLAMTSGQMWNHIR
GPPYAHKNPHTGHVNYIHGSSQAQFVAETHIVLLFNGGVTLGMVLLCEAATSDMDIGKRK
IMCVAGIGLVVLFFSWMLSIFRSKYHGYPYSFLMS

Signal peptide:
amino acids 1-29

Transmembrane domains:
amino acids 183-205, 217-237, 217-287, 301-321

FIGURE 191

```
GAGAGAAGTCAGCCTGGCAGAGAGACTCTGAAATGAGGGATTAGAGGTGTTCAAGGAGCA
AGAGCTTCAGCCTGAAGACAAGGGAGCAGTCCCTGAAGACGCTTCTACTGAGAGGTCTGC
CATGGCCTCTCTTGGCCTCCAACTTGTGGGCTACATCCTAGGCCTTCTGGGGCTTTTGGG
CACACTGGTTGCCATGCTGCTCCCCAGCTGGAAAACAAGTTCTTATGTCGGTGCCAGCAT
TGTGACAGCAGTTGGCTTCTCCAAGGGCCTCTGGATGGAATGTGCCACACACAGCACAGG
CATCACCCAGTGTGACATCTATAGCACCCTTCTGGGCCTGCCCGCTGACATCCAGGCTGC
CCAGGCCATGATGGTGACATCCAGTGCAATCTCCTCCCTGGCCTGCATTATCTCTGTGGT
GGGCATGAGATGCACAGTCTTCTGCCAGGAATCCCGAGCCAAAGACAGAGTGGCGGTAGC
AGGTGGAGTCTTTTTCATCCTTGGAGGCCTCCTGGGATTCATTCCTGTTGCCTGGAATCT
TCATGGGATCCTACGGGACTTCTACTCACCACTGGTGCCTGACAGCATGAAATTTGAGAT
TGGAGAGGCTCTTTACTTGGGCATTATTTCTTCCCTGTTCTCCCTGATAGCTGGAATCAT
CCTCTGCTTTTCCTGCTCATCCCAGAGAAATCGCTCCAACTACTACGATGCCTACCAAGC
CCAACCTCTTGCCACAAGGAGCTCTCCAAGGCCTGGTCAACCTCCCAAAGTCAAGAGTGA
GTTCAATTCCTACAGCCTGACAGGGTATGTGTGAAGAACCAGGGGCCAGAGCTGGGGGGT
GGCTGGGTCTGTGAAAAACAGTGGACAGCACCCCGAGGGCCACAGGTGAGGGACACTACC
ACTGGATCGTGTCAGAAGGTGCTGCTGAGGATAGACTGACTTTGGCCATTGGATTGAGCA
AAGGCAGAAATGGGGCTAGTGTAACAGCATGCAGGTTGAATTGCCAAGGATGCTCGCCA
TGCCAGCCTTTCTGTTTTCCTCACCTTGCTGCTCCCCTGCCCTAAGTCCCCAACCCTCAA
CTTGAAACCCCATTCCCTTAAGCCAGGACTCAGAGGATCCCTTTGCCCTCTGGTTTACCT
GGGACTCCATCCCCAAACCCACTAATCACATCCACTGACTGACCCTCTGTGATCAAAGA
CCCTCTCTCTGGCTGAGGTTGGCTCTTAGCTCATTGCTGGGGATGGGAAGGAGAAGCAGT
GGCTTTTGTGGGCATTGCTCTAACCTACTTCTCAAGCTTCCCTCCAAAGAAACTGATTGG
CCCTGGAACCTCCATCCCACTCTTGTTATGACTCCACAGTGTCCAGACTAATTTGTGCAT
GAACTGAAATAAAACCATCCTACGGTATCCAGGGAACAGAAAGCAGGATGCAGGATGGGA
GGACAGGAAGGCAGCCTGGGACATTTAAAAAAATA
```

FIGURE 192

MASLGLQLVGYILGLLGLLGTLVAMLLPSWKTSSYVGASIVTAVGFSKGLWMECATHSTG
ITQCDIYSTLLGLPADIQAAQAMMVTSSAISSLACIISVVGMRCTVFCQESRAKDRVAVA
GGVFFILGGLLGFIPVAWNLHGILRDFYSPLVPDSMKFEIGEALYLGIISSLFSLIAGII
LCFSCSSQRNRSNYYDAYQAQPLATRSSPRPGQPPKVKSEFNSYSLTGYV

Important features of the protein:
Signal peptide:
amino acids 1-24

Transmembrane domains:
amino acids 82-102, 117-140, 163-182

N-glycosylation site:
amino acids 190-193

PMP-22 / EMP / MP20 family proteins:
amino acids 46-59

FIGURE 193

CTCCACTGCAACCACCCAGAGCATGGCTCCCCGAGGCTGCATCGTAGCTGTCTTTGCCA
TTTTCTGCATCTCCAGGCTCCTCTGCTCACACGGAGCCCCAGTGGCCCCCATGACTCCTT
ACCTGATGCTGTGCCAGCCACACAAGAGATGTGGGACAAGTTCTACGACCCCCTGCAGC
ACTGTTGCTATGATGATGCCGTCGTGCCCTTGGCCAGGACCCAGACGTGTGGAAACTGCA
CCTTCAGAGTCTGCTTTGAGCAGTGCTGCCCCTGGACCTTCATGGTGAAGCTGATAAACC
AGAACTGCGACTCAGCCCGGACCTCGGATGACAGGCTTTGTCGCAGTGTCAGCTAATGGA
ACATCAGGGGAACGATGACTCCTGGATTCTCCTTCCTGGGTGGGCCTGGAGAAAGAGGCT
GGTGTTACCTGAGATCTGGGATGCTGAGTGGCTGTTTGGGGGCCAGAGAAACACACACTC
AACTGCCCACTTCATTCTGTGACCTGTCTGAGGCCCACCCTGCAGCTGCCTGAGGAGGC
CCACAGGTCCCCTTCTAGAATTCTGGACAGCATGAGATGCGTGTGCTGATGGGGGCCCAG
GGACTCTGAACCCTCCTGATGACCCTATGGCCAACATCAACCCGGCACCACCCAAGGC
TGGCTGGGGAACCCTTCACCCTTCTGTGAGATTTTCCATCATCTCAAGTTCTCTTCTATC
CAGGAGCAAAGCACAGGATCATAATAAATTTATGTACTTTATAAATGAAAA

FIGURE 194

MAPRGCIVAVFAIFCISRLLCSHGAPVAPMTPYLMLCQPHKRCGDKFYDPLQHCCYDDAV
VPLARTQTCGNCTFRVCFEQCCPWTFMVKLINQNCDSARTSDDRLCRSVS

Signal peptide:
amino acids 1-24

FIGURE 195

CATTTCCAACAAGAGCACTGGCCAAGTCAGCTTCTTCTGAGAGAGTCTCTAGAAGACATG
ATGCTACACTCAGCTTTGGGTCTCTGCCTCTTACTCGTCACAGTTTCTTCCAACCTTGCC
ATTGCAATAAAAAGGAAAAGAGGCCTCCTCAGACACTCTCAAGAGGATGGGGAGATGAC
ATCACTTGGGTACAAACTTATGAAGAAGGTCTCTTTTATGCTCAAAAAAGTAAGAAGCCA
TTAATGGTTATTCATCACCTGGAGGATTGTCAATACTCTCAAGCACTAAAGAAAGTATTT
GCCCAAAATGAAGAAATACAAGAAATGGCTCAGAATAAGTTCATCATGCTAAACCTTATG
CATGAAACCACTGATAAGAATTTATCACCTGATGGGCAATATGTGCCTAGAATCATGTTT
GTAGACCCTTCTTTAACAGTTAGAGCTGACATAGCTGGAAGATACTCTAACAGATTGTAC
ACATATGAGCCTCGGGATTTACCCCTATTGATAGAAAACATGAAGAAAGCATTAAGACTT
ATTCAGTCAGAGCTATAAGAGATGATGGAAAAAGCCTTCACTTCAAGAAGTCAAATTT
CATGAAGAAACCTCTGGCACATTGACAAATACTAAATGTGCAAGTATATAGATTTTGTA
ATATTACTATTTAGTTTTTTTAATGTGTTTGCAATAGTCTTATTAAAATAAATGTTTTTT
AAATCTGA

FIGURE 196

MMLHSALGLCLLLVTVSSNLAIAIKKEKRPPQTLSRGWGDDITWVQTYEEGLFYAQKSKK
PLMVIHHLEDCQYSQALKKVFAQNEEIQEMAQNKFIMLNLMHETTDKNLSPDGQYVPRIM
FVDPSLTVRADIAGRYSNRLYTYEPRDLPLLIENMKKALRLIQSEL

Important features:
Signal peptide:
amino acids 1-23

N-myristoylation site:
amino acids 51-57

FIGURE 197

```
GGGGGCGGGTGCCTGGAGCACGGCGCTGGGGCCGCCCGCAGCGCTCACTCGCTCGCACTC
AGTCGCGGGAGGCTTCCCCGCGCCGGCCGCGTCCCGCCCGCTCCCCGGCACCAGAAGTTC
CTCTGCGCGTCCGACGGCGACATGGGCGTCCCCACGGCCCTGGAGGCCGGCAGCTGGCGC
TGGGGATCCCTGCTCTTCGCTCTCTTCCTGGCTGCGTCCCTAGGTCCGGTGGCAGCCTTC
AAGGTCGCCACGCCGTATTCCCTGTATGTCTGTCCCGAGGGGCAGAACGTCACCCTCACC
TGCAGGCTCTTGGGCCCTGTGGACAAAGGGCACGATGTGACCTTCTACAAGACGTGGTAC
CGCAGCTCGAGGGGCGAGGTGCAGACCTGCTCAGAGCGCCGGCCCATCCGCAACCTCACG
TTCCAGGACCTTCACCTGCACCATGGAGGCCACCAGGCTGCCAACACCAGCCACGACCTG
GCTCAGCGCCACGGGCTGGAGTCGGCCTCCGACCACCATGGCAACTTCTCCATCACCATG
CGCAACCTGACCCTGCTGGATAGCGGCCTCTACTGCTGCCTGGTGGTGGAGATCAGGCAC
CACCACTCGGAGCACAGGGTCCATGGTGCCATGGAGCTGCAGGTGCAGACAGGCAAAGAT
GCACCATCCAACTGTGTGGTGTACCCATCCTCCTCCCAGGATAGTGAAAACATCACGGCT
GCAGCCCTGGCTACGGGTGCCTGCATCGTAGGAATCCTCTGCCTCCCCCTCATCCTGCTC
CTGGTCTACAAGCAAAGGCAGGCAGCCTCCAACCGCCGTGCCCAGGAGCTGGTGCGGATG
GACAGCAACATTCAAGGGATTGAAAACCCCGGCTTTGAAGCCTCACCACCTGCCCAGGGG
ATACCCGAGGCCAAAGTCAGGCACCCCCTGTCCTATGTGGCCCAGCGGCAGCCTTCTGAG
TCTGGGCGGCATCTGCTTTCGGAGCCCAGCACCCCCTGTCTCCTCCAGGCCCCGGAGAC
GTCTTCTTCCCATCCCTGGACCCTGTCCTGACTCTCCAAACTTTGAGGTCATCTAGCCC
AGCTGGGGGACAGTGGGCTGTTGTGGCTGGGTCTGGGGCAGGTGCATTTGAGCCAGGGCT
GGCTCTGTGAGTGGCCTCCTTGGCCTCGGCCCTGGTTCCCTCCCTCCTGCTCTGGGCTCA
GATACTGTGACATCCCAGAAGCCCAGCCCCTCAACCCCTCTGGATGCTACATGGGGATGC
TGGACGGCTCAGCCCCTGTTCCAAGGATTTTGGGGTGCTGAGATTCTCCCCTAGAGACCT
GAAATTCACCAGCTACAGATGCCAAATGACTTACATCTTAAGAAGTCTCAGAACGTCCAG
CCCTTCAGCAGCTCTCGTTCTGAGACATGAGCCTTGGGATGTGGCAGCATCAGTGGGACA
AGATGGACACTGGGCCACCCTCCCAGGCACCAGACACAGGGCACGGTGGAGAGACTTCTC
CCCCGTGGCCGCCTTGGCTCCCCGTTTTGCCCGAGGCTGCTCTTCTGTCAGACTTCCTC
TTTGTACCACAGTGGCTCTGGGGCCAGGCCTGCCTGCCCACTGGCCATCGCCACCTTCCC
CAGCTGCCTCCTACCAGCAGTTTCTCTGAAGATCTGTCAACAGGTTAAGTCAATCTGGGG
CTTCCACTGCCTGCATTCCAGTCCCCAGAGCTTGGTGGTCCCGAAACGGGAAGTACATAT
TGGGGCATGGTGGCCTCCGTGAGCAAATGGTGTCTTGGGCAATCTGAGGCCAGGACAGAT
GTTGCCCCACCCACTGGAGATGGTGCTGAGGGAGGTGGGTGGGGCCTTCTGGGAAGGTGA
GTGGAGAGGGGCACCTGCCCCCGCCCTCCCCATCCCCTACTCCCACTGCTCAGCGCGGG
CCATTGCAAGGGTGCCACACAATGTCTTGTCCACCCTGGGACACTTCTGAGTATGAAGCG
GGATGCTATTAAAAACTACATGGGGAAAAAAAAAAAAAAAAAAAAAAAAAAAAAAAAAAA
AAGA
```

FIGURE 198

MGVPTALEAGSWRWGSLLFALFLAASLGPVAAFKVATPYSLYVCPEGQNVTLTCRLLGPV
DKGHDVTFYKTWYRSSRGEVQTCSERRPIRNLTFQDLHLHHGGHQAANTSHDLAQRHGLE
SASDHHGNFSITMRNLTLLDSGLYCCLVVEIRHHHSEHRVHGAMELQVQTGKDAPSNCVV
YPSSSQDSENITAAALATGACIVGILCLPLILLLVYKQRQAASNRRAQELVRMDSNIQGI
ENPGFEASPPAQGIPEAKVRHPLSYVAQRQPSESGRHLLSEPSTPLSPPGPGDVFFPSLD
PVPDSPNFEVI

Signal peptide:
amino acids 1-28

Transmembrane domain:
amino acids 190-216

FIGURE 199

CTAGCCTGCGCCAAGGGGTAGTGAGACCGCGCGGCAACAGCTTGCGGCTGCGGGGAGCTC
CCGTGGGCGCTCCGCTGGCTGTGCAGGCGGCCATGGATTCCTTGCGGAAAATGCTGATCT
CAGTCGCAATGCTGGGCGCAGGGGCTGGCGTGGGCTACGCGCTCCTCGTTATCGTGACCC
CGGGAGAGCGGCGGAAGCAGGAAATGCTAAAGGAGATGCCACTGCAGGACCCAAGGAGCA
GGGAGGAGGCGGCCAGGACCCAGCAGCTATTGCTGGCCACTCTGCAGGAGGCAGCGACCA
CGCAGGAGAACGTGGCCTGGAGGAAGAACTGGATGGTTGGCGGCGAAGGCGGCGCCAGCG
GGAGGTCACCGTGAGACCGGACTTGCCTCCGTGGGCGCCGGACCTTGGCTTGGGCGCAGG
AATCCGAGGCAGCCTTTCTCCTTCGTGGGCCCAGCGGAGAGTCCGGACCGAGATACCATG
CCAGGACTCTCCGGGGTCCTGTGAGCTGCCGTCGGGTGAGCACGTTTCCCCCAAACCCTG
GACTGACTGCTTTAAGGTCCGCAAGGCGGGCCAGGGCCGAGACGCGAGTCGGATGTGGTG
AACTGAAAGAACCAATAAAATCATGTTCCTCCAAAAAAAAAAAAAAAAAAAAAAAAAAAA
AAAAAAAAAAAAAAAAAAAAAAAAAAAAAAA

FIGURE 200

MDSLRKMLISVAMLGAGAGVGYALLVIVTPGERRKQEMLKEMPLQDPRSREEAARTQQLL
LATLQEAATTQENVAWRKNWMVGGEGGASGRSP

Signal peptide:
amino acids 1-18

FIGURE 201

```
GACAGCTGTGTCTCGATGGAGTAGACTCTCAGAACAGCGCAGTTTGCCCTCCGCTCACGC
AGAGCCTCTCCGTGGCTTCCGCACCTTGAGCATTAGGCCAGTTCTCCTCTTCTCTCTAAT
CCATCCGTCACCTCTCCTGTCATCCGTTTCCATGCCGTGAGGTCCATTCACAGAACACAT
CCATGGCTCTCATGCTCAGTTTGGTTCTGAGTCTCCTCAAGCTGGGATCAGGGCAGTGGC
AGGTGTTTGGGCCAGACAAGCCTGTCCAGGCCTTGGTGGGGGAGGACGCAGCATTCTCCT
GTTTCCTGTCTCCTAAGACCAATGCAGAGGCCATGGAAGTGCGGTTCTTCAGGGGCCAGT
TCTCTAGCGTGGTCCACCTCTACAGGGACGGGAAGGACCAGCCATTTATGCAGATGCCAC
AGTATCAAGGCAGGACAAAACTGGTGAAGGATTCTATTGCGGAGGGGCGCATCTCTCTGA
GGCTGGAAAACATTACTGTGTTGGATGCTGGCCTCTATGGGTGCAGGATTAGTTCCCAGT
CTTACTACCAGAAGGCCATCTGGGAGCTACAGGTGTCAGCACTGGGCTCAGTTCCTCTCA
TTTCCATCACGGGATATGTTGATAGAGACATCCAGCTACTCTGTCAGTCCTCGGGCTGGT
TCCCCCGGCCCACAGCGAAGTGGAAAGGTCCACAAGGACAGGATTTGTCCACAGACTCCA
GGACAAACAGAGACATGCATGGCCTGTTTGATGTGGAGATCTCTCTGACCGTCCAAGAGA
ACGCCGGGAGCATATCCTGTTCCATGCGGCATGCTCATCTGAGCCGAGAGGTGGAATCCA
GGGTACAGATAGGAGATACCTTTTTCGAGCCTATATCGTGGCACCTGGCTACCAAAGTAC
TGGGAATACTCTGCTGTGGCCTATTTTTTGGCATTGTTGGACTGAAGATTTTCTTCTCCA
AATTCCAGTGGAAAATCCAGGCGGAACTGGACTGGAGAAGAAAGCACGGACAGGCAGAAT
TGAGAGACGCCCGGAAACACGCAGTGGAGGTGACTCTGGATCCAGAGACGGCTCACCCGA
AGCTCTGCGTTTCTGATCTGAAAACTGTAACCCATAGAAAAGCTCCCCAGGAGGTGCCTC
ACTCTGAGAAGAGATTTACAAGGAAGAGTGTGGTGGCTTCTCAGAGTTTCCAAGCAGGGA
AACATTACTGGGAGGTGGACGGAGGACACAATAAAAGGTGGCGCGTGGGAGTGTGCCGGG
ATGATGTGGACAGGAGGAAGGAGTACGTGACTTTGTCTCCCGATCATGGGTACTGGGTCC
TCAGACTGAATGGAGAACATTTGTATTTCACATTAAATCCCCGTTTTATCAGCGTCTTCC
CCAGGACCCCACCTACAAAAATAGGGGTCTTCCTGGACTATGAGTGTGGGACCATCTCCT
TCTTCAACATAAATGACCAGTCCCTTATTTATACCCTGACATGTCGGTTTGAAGGCTTAT
TGAGGCCCTACATTGAGTATCCGTCCTATAATGAGCAAAATGGAACTCCCATAGTCATCT
GCCCAGTCACCCAGGAATCAGAGAAAGAGGCCTCTTGGCAAAGGGCCTCTGCAATCCCAG
AGACAAGCAACAGTGAGTCCTCCTCACAGGCAACCACGCCCTTCCTCCCCAGGGGTGAAA
TGTAGGATGAATCACATCCCACATTCTTCTTTAGGGATATTAAGGTCTCTCTCCCAGATC
CAAAGTCCCGCAGCAGCCGGCCAAGGTGGCTTCCAGATGAAGGGGGACTGGCCTGTCCAC
ATGGGAGTCAGGTGTCATGGCTGCCCTGAGCTGGGAGGGAAGAAGGCTGACATTACATTT
AGTTTGCTCTCACTCCATCTGGCTAAGTGATCTTGAAATACCACCTCTCAGGTGAAGAAC
CGTCAGGAATTCCCATCTCACAGGCTGTGGTGTAGATTAAGTAGACAAGGAATGTGAATA
ATGCTTAGATCTTATTGATGACAGAGTGTATCCTAATGGTTTGTTCATTATATTACACTT
TCAGTAAAAAAA
```

FIGURE 202

MALMLSLVLSLLKLGSGQWQVFGPDKPVQALVGEDAAFSCFLSPKTNAEAMEVRFFRGQF
SSVVHLYRDGKDQPFMQMPQYQGRTKLVKDSIAEGRISLRLENITVLDAGLYGCRISSQS
YYQKAIWELQVSALGSVPLISITGYVDRDIQLLCQSSGWFPRPTAKWKGPQGQDLSTDSR
TNRDMHGLFDVEISLTVQENAGSISCSMRHAHLSREVESRVQIGDTFFEPISWHLATKVL
GILCCGLFFGIVGLKIFFSKFQWKIQAELDWRRKHGQAELRDARKHAVEVTLDPETAHPK
LCVSDLKTVTHRKAPQEVPHSEKRFTRKSVVASQSFQAGKHYWEVDGGHNKRWRVGVCRD
DVDRRKEYVTLSPDHGYWVLRLNGEHLYFTLNPRFISVFPRTPPTKIGVFLDYECGTISF
FNINDQSLIYTLTCRFEGLLRPYIEYPSYNEQNGTPIVICPVTQESEKEASWQRASAIPE
TSNSESSSQATTPFLPRGEM

Signal peptide:
amino acids 1-17

Transmembrane domain:
amino acids 239-255

FIGURE 203

TGCGGCGCAGTGTAGACCTGGGAGGATGGGCGGCCTGCTGCTGGCTGCTTTTCTGGCTTT
GGTCTCGGTGCCCAGGGCCCAGGCCGTGTGGTTGGGAAGACTGGACCCTGAGCAGCTTCT
TGGGCCCTGGTACGTGCTTGCGGTGGCCTCCCGGGAAAAGGGCTTTGCCATGGAGAAGGA
CATGAAGAACGTCGTGGGGGTGGTGGTGACCCTCACTCCAGAAAACAACCTGCGGACGCT
GTCCTCTCAGCACGGGCTGGGAGGGTGTGACCAGAGTGTCATGGACCTGATAAAGCGAAA
CTCCGGATGGGTGTTTGAGAATCCCTCAATAGGCGTGCTGGAGCTCTGGGTGCTGGCCAC
CAACTTCAGAGACTATGCCATCATCTTCACTCAGCTGGAGTTCGGGGACGAGCCCTTCAA
CACCGTGGAGCTGTACAGTCTGACGGAGACAGCCAGCCAGGAGGCCATGGGGCTCTTCAC
CAAGTGGAGCAGGAGCCTGGGCTTCCTGTCACAGTAGCAGGCCCAGCTGCAGAAGGACCT
CACCTGTGCTCACAAGATCCTTCTGTGAGTGCTGCGTCCCCAGTAGGGATGGCGCCCACA
GGGTCCTGTGACCTCGGCCAGTGTCCACCCACCTCGCTCAGCGGCTCCCGGGGCCCAGCA
CCAGCTCAGAATAAAGCGATTCCACAGCA

FIGURE 204

MGGLLLAAFLALVSVPRAQAVWLGRLDPEQLLGPWYVLAVASREKGFAMEKDMKNVVGVV
VTLTPENNLRTLSSQHGLGGCDQSVMDLIKRNSGWVFENPSIGVLELWVLATNFRDYAII
FTQLEFGDEPFNTVELYSLTETASQEAMGLFTKWSRSLGFLSQ

Signal peptide:
amino acids 1-20

FIGURE 205

```
GACGCCCAGTGACCTGCCGAGGTCGGCAGCACAGAGCTCTGGAGATGAAGACCCTGTTCC
TGGGTGTCACGCTCGGCCTGGCCGCTGCCCTGTCCTTCACCCTGGAGGAGGAGGATATCA
CAGGGACCTGGTACGTGAAGGCCATGGTGGTCGATAAGGACTTTCCGGAGGACAGGAGGC
CCAGGAAGGTGTCCCCAGTGAAGGTGACAGCCCTGGGCGGTGGGAAGTTGGAAGCCACGT
TCACCTTCATGAGGGAGGATCGGTGCATCCAGAAGAAAATCCTGATGCGGAAGACGGAGG
AGCCTGGCAAATACAGCGCCTATGGGGGCAGGAAGCTCATGTACCTGCAGGAGCTGCCCA
GGAGGGACCACTACATCTTTTACTGCAAAGACCAGCACCATGGGGGCCTGCTCCACATGG
GAAAGCTTGTGGGTAGGAATTCTGATACCAACCGGGAGGCCCTGGAAGAATTTAAGAAAT
TGGTGCAGCGCAAGGGACTCTCGGAGGAGGACATTTTCACGCCCCTGCAGACGGGAAGCT
GCGTTCCCGAACACTAGGCAGCCCCGGGTCTGCACCTCCAGAGCCCACCCTACCACCAG
ACACAGAGCCCGGACCACCTGGACCTACCCTCCAGCCATGACCCTTCCCTGCTCCACCC
ACCTGACTCCAAATAAAGTCCTTTTCCCCCAAAAAAAAAAAAAAAAAAAAAAAAAAAAA
AAAAAAAAAAAAAAAAAA
```

FIGURE 206

MKTLFLGVTLGLAAALSFTLEEEDITGTWYVKAMVVDKDFPEDRRPRKVSPVKVTALGGG
KLEATFTFMREDRCIQKKILMRKTEEPGKYSAYGGRKLMYLQELPRRDHYIFYCKDQHHG
GLLHMGKLVGRNSDTNREALEEFKKLVQRKGLSEEDIFTPLQTGSCVPEH

Important features:
Signal peptide:
amino acids 1-17

FIGURE 207

```
GTTCCGCAGATGCAGAGGTTGAGGTGGCTGCGGGACTGGAAGTCATCGGGCAGAGGTCTC
ACAGCAGCCAAGGAACCTGGGGCCCGCTCCTCCCCCCTCCAGGCCATGAGGATTCTGCAG
TTAATCCTGCTTGCTCTGGCAACAGGGCTTGTAGGGGAGAGACCAGGATCATCAAGGGG
TTCGAGTGCAAGCCTCACTCCCAGCCCTGGCAGGCAGCCCTGTTCGAGAAGACGCGGCTA
CTCTGTGGGGCGACGCTCATCGCCCCAGATGGCTCCTGACAGCAGCCCACTGCCTCAAG
CCCCGCTACATAGTTCACCTGGGGCAGCACAACCTCCAGAAGGAGGAGGGCTGTGAGCAG
ACCCGGACAGCCACTGAGTCCTTCCCCCACCCCGGCTTCAACAACAGCCTCCCCAACAAA
GACCACCGCAATGACATCATGCTGGTGAAGATGGCATCGCCAGTCTCCATCACCTGGGCT
GTGCGACCCCTCACCCTCTCCTCACGCTGTGTCACTGCTGGCACCAGCTGCCTCATTTCC
GGCTGGGGCAGCACGTCCAGCCCCAGTTACGCCTGCCTCACACCTTGCGATGCGCCAAC
ATCACCATCATTGAGCACCAGAAGTGTGAGAACGCCTACCCCGGCAACATCACAGACACC
ATGGTGTGTGCCAGCGTGCAGGAAGGGGGCAAGGACTCCTGCCAGGGTGACTCCGGGGC
CCTCTGGTCTGTAACCAGTCTCTTCAAGGCATTATCTCCTGGGGCCAGGATCCGTGTGCG
ATCACCCGAAAGCCTGGTGTCTACACGAAAGTCTGCAAATATGTGGACTGGATCCAGGAG
ACGATGAAGAACAATTAGACTGGACCCACCCACCACAGCCCATCACCCTCCATTTCCACT
TGGTGTTTGGTTCCTGTTCACTCTGTTAATAAGAAACCCTAAGCCAAGACCCTCTACGAA
CATTCTTTGGGCCTCCTGGACTACAGGAGATGCTGTCACTTAATAATCAACCTGGGGTTC
GAAATCAGTGAGACCTGGATTCAAATTCTGCCTTGAAATATTGTGACTCTGGGAATGACA
ACACCTGGTTTGTTCTCTGTTGTATCCCCAGCCCCAAAGACAGCTCCTGGCCATATATCA
AGGTTTCAATAAATATTTGCTAAATGAAAAAAAAAAAAAAAAAAAAAAAAAAAAAAAA
AAAA
```

FIGURE 208

MRILQLILLALATGLVGGETRIIKGFECKPHSQPWQAALFEKTRLLCGATLIAPRWLLTA
AHCLKPRYIVHLGQHNLQKEEGCEQTRTATESFPHPGFNNSLPNKDHRNDIMLVKMASPV
SITWAVRPLTLSSRCVTAGTSCLISGWGSTSSPQLRLPHTLRCANITIIEHQKCENAYPG
NITDTMVCASVQEGGKDSCQGDSGGPLVCNQSLQGIISWGQDPCAITRKPGVYTKVCKYV
DWIQETMKNN

Important features:
Signal peptide:
amino acids 1-18

Serine proteases, trypsin family, histidine active site:
amino acids 58-63

N-glycosylation sites:
amino acids 99-102, 165-168, 181-184, 210-213

Glycosaminoglycan attachment site:
amino acids 145-148

Kringle domain proteins:
amino acids 197-209, 47-64

Serine proteases, trypsin family, histidine protein:
amino acids 199-209, 47-63, 220-243

Apple domain proteins:
amino acids 222-249, 189-222

FIGURE 209

```
GCGGCCACACGCAGCTAGCCGGAGCCCGGACCAGGCGCCTGTGCCTCCTCCTCGTCCCTC
GCCGCGTCCGCGAAGCCTGGAGCCGGCGGGAGCCCCGCGCTCGCCATGTCGGGCGAGCTC
AGCAACAGGTTCCAAGGAGGGAAGGCGTTCGGCTTGCTCAAAGCCCGGCAGGAGAGGAGG
CTGGCCGAGATCAACCGGGAGTTTCTGTGTGACCAGAAGTACAGTGATGAAGAGAACCTT
CCAGAAAAGCTCACAGCCTTCAAAGAGAAGTACATGGAGTTTGACCTGAACAATGAAGGC
GAGATTGACCTGATGTCTTTAAAGAGGATGATGGAGAAGCTTGGTGTCCCCAAGACCCAC
CTGGAGATGAAGAAGATGATCTCAGAGGTGACAGGAGGGGTCAGTGACACTATATCCTAC
CGAGACTTTGTGAACATGATGCTGGGGAAACGGTCGGCTGTCCTCAAGTTAGTCATGATG
TTTGAAGGAAAAGCCAACGAGAGCAGCCCCAAGCCAGTTGGCCCCCCTCCAGAGAGAGAC
ATTGCTAGCCTGCCCTGAGGACCCCGCCTGGACTCCCCAGCCTTCCCACCCCATACCTCC
CTCCCGATCTTGCTGCCCTTCTTGACACACTGTGATCTCTCTCTCTCATTTGTTTGGT
CATTGAGGGTTTGTTTGTGTTTTCATCAATGTCTTTGTAAAGCACAAATTATCTGCCTTA
AAGGGGCTCTGGGTCGGGGAATCCTGAGCCTTGGGTCCCCTCCCTCTCTTCTTCCCTCCT
TCCCCGCTCCCTGTGCAGAAGGGCTGATATCAAACCAAAAACTAGAGGGGGCAGGGCCAG
GGCAGGGAGGCTTCCAGCCTGTGTTCCCCTCACTTGGAGGAACCAGCACTCTCCATCCTT
TCAGAAAGTCTCCAAGCCAAGTTCAGGCTCACTGACCTGGCTCTGACGAGGACCCCAGGC
CACTCTGAGAAGACCTTGGAGTAGGGACAAGGCTGCAGGGCCTCTTTCGGGTTTCCTTGG
ACAGTGCCATGGTTCCAGTGCTCTGGTGTCACCCAGGACACAGCCACTCGGGGCCCCGCT
GCCCCAGCTGATCCCCACTCATTCCACACCTCTTCTCATCCTCAGTGATGTGAAGGTGGG
AAGGAAAGGAGCTTGGCATTGGGAGCCCTTCAAGAAGGTACCAGAAGGAACCCTCCAGTC
CTGCTCTCTGGCCACACCTGTGCAGGCAGCTGAGAGGCAGCGTGCAGCCCTACTGTCCCT
TACTGGGGCAGCAGAGGGCTTCGGAGGCAGAAGTGAGGCCTGGGGTTTGGGGGGAAAGGT
CAGCTCAGTGCTGTTCCACCTTTTAGGGAGGATACTGAGGGGACCAGGATGGGAGAATGA
GGAGTAAAATGCTCACGGCAAAGTCAGCAGCACTGGTAAGCCAAGACTGAGAAATACAAG
GTTGCTTGTCTGACCCCAATCTGCTTGAAAAAAAAAAAAAAAAAA
```

FIGURE 210

MSGELSNRFQGGKAFGLLKARQERRLAEINREFLCDQKYSDEENLPEKLTAFKEKYMEFD
LNNEGEIDLMSLKRMMEKLGVPKTHLEMKKMISEVTGGVSDTISYRDFVNMMLGKRSAVL
KLVMMFEGKANESSPKPVGPPPERDIASLP

FIGURE 211

CTGGGATCAGCCACTGCAGCTCCCTGAGCACTCTCTACAGAGACGCGGACCCCAGACATG
AGGAGGCTCCTCCTGGTCACCAGCCTGGTGGTTGTGCTGCTGTGGGAGGCAGGTGCAGTC
CCAGCACCCAAGGTCCCTATCAAGATGCAAGTCAAACACTGGCCCTCAGAGCAGGACCCA
GAGAAGGCCTGGGCGCCCGTGTGGTGGAGCCTCCGGAGAAGGACGACCAGCTGGTGGTG
CTGTTCCCTGTCCAGAAGCCGAAACTCTTGACCACCGAGGAGAAGCCACGAGGTCAGGGC
AGGGGCCCCATCCTTCCAGGCACCAAGGCCTGGATGGAGACCGAGGACACCCTGGGCCGT
GTCCTGAGTCCCGAGCCCGACCATGACAGCCTGTACCACCCTCCGCCTGAGGAGGACCAG
GGCGAGGAGAGGCCCCGGTTGTGGGTGATGCCAAATCACCAGGTGCTCCTGGGACCGGAG
GAAGACCAAGACCACATCTACCACCCCAGTAGGGCTCCAGGGGCCATCACTGCCCCCGC
CCTGTCCCAAGGCCCAGGCTGTTGGGACTGGGACCCTCCCTACCCTGCCCCAGCTAGACA
AATAAACCCCAGCAGGCAAAAAAAAAAAAAAAAAAA

FIGURE 212

MRRLLLVTSLVVVLLWEAGAVPAPKVPIKMQVKHWPSEQDPEKAWGARVVEPPEKDDQLV
VLFPVQKPKLLTTEEKPRGQGRGPILPGTKAWMETEDTLGRVLSPEPDHDSLYHPPPEED
QGEERPRLWVMPNHQVLLGPEEDQDHIYHPQ

FIGURE 213

```
CAGGCAGAAGCGAACAAAGACCCAGCAAGAGAAGGCAGAGGCTAAGACCCATCCCGTATC
TGCTCTCCTGAAATAATTCTGGAGTCATGCCTGAAATGCCAGAGGACATGGAGCAGGAGG
AAGTTAACATCCCTAATAGGAGGGTTCTGGTTACTGGTGCCACTGGGCTTCTTGGCAGAG
CTGTACACAAAGAATTTCAGCAGAATAATTGGCATGCAGTTGGCTGTGGTTTCAGAAGAG
CAAGACCAAAATTTGAACAGGTTAATCTGTTGGATTCTAATGCAGTTCATCACATCATTC
ATGATTTTCAGCCCCATGTTATAGTACATTGTGCAGCAGAGAGAAGACCAGATGTTGTAG
AAAATCAGCCAGATGCTGCCTCTCAACTTAATGTGGATGCTTCTGGGAATTTAGCAAAGG
AAGCAGCTGCTGTTGGAGCATTTCTCATCTACATTAGCTCAGATTATGTATTTGATGGAA
CAAATCCACCTTACAGAGAGGAAGACATACCAGCTCCCCTAAATTTGTATGGCAAAACAA
AATTAGATGGAGAAAAGGCTGTCCTGGAGAACAATCTAGGAGCTGCTGTTTTGAGGATTC
CTATTCTGTATGGGGAAGTTGAAAAGCTCGAAGAAAGTGCTGTGACTGTTATGTTTGATA
AAGTGCAGTTCAGCAACAAGTCAGCAAACATGGATCACTGGCAGCAGAGGTTCCCCACAC
ATGTCAAAGATGTGGCCACTGTGTGCCGGCAGCTAGCAGAGAAGAGAATGCTGGATCCAT
CAATTAAGGGAACCTTTCACTGGTCTGGCAATGAACAGATGACTAAGTATGAAATGGCAT
GTGCAATTGCAGATGCCTTCAACCTCCCCAGCAGTCACTTAAGACCTATTACTGACAGCC
CTGTCCTAGGAGCACAACGTCCGAGAAATGCTCAGCTTGACTGCTCCAAATTGGAGACCT
TGGGCATTGGCCAACGAACACCATTTCGAATTGGAATCAAAGAATCACTTTGGCCTTTCC
TCATTGACAAGAGATGGAGACAAACGGTCTTTCATTAGTTTATTTGTGTTGGGTTCTTTT
TTTTTTTAAATGAAAAGTATAGTATGTGGCACTTTTTAAAGAACAAAGGAAATAGTTTTG
TATGAGTACTTTAATTGTGACTCTTAGGATCTTTCAGGTAAATGATGCTCTTGCACTAGT
GAAATTGTCTAAAGAAACTAAAGGGCAGTCATGCCCTGTTTGCAGTAATTTTTCTTTTTA
TCATTTTGTTTGTCCTGGCTAAACTTGGAGTTTGAGTATAGTAAATTATGATCCTTAAAT
ATTTGAGAGTCAGGATGAAGCAGATCTGCTGTAGACTTTTCAGATGAAATTGTTCATTCT
CGTAACCTCCATATTTTCAGGATTTTTGAAGCTGTTGACCTTTTCATGTTGATTATTTTA
AATTGTGTGAAATAGTATAAAAATCATTGGTGTTCATTATTTGCTTTGCCTGAGCTCAGA
TCAAAATGTTTGAAGAAAGGAACTTTATTTTTGCAAGTTACGTACAGTTTTTATGCTTGA
GATATTTCAACATGTTATGTATATTGGAACTTCTACAGCTTGATGCCTCCTGCTTTTATA
GCAGTTTATGGGGAGCACTTGAAAGAGCGTGTGTACATGTATTTTTTTCTAGGCAAACA
TTGAATGCAAACGTGTATTTTTTAATATAAATATATAACTGTCCTTTTCATCCCATGTT
GCCGCTAAGTGATATTTCATATGTGTGGTTATACTCATAATAATGGGCCTTGTAAGTCTT
TTCACCATTCATGAATAATAATAAATATGTACTGCTGGCATGTAATGCTTAGTTTTCTTG
TATTTACTTCTTTTTTTAAATGTAAGGACCAAACTTCTAAACTAATTGTTCTTTTGTTGC
TTTAATTTTTAAAAATTACATTCTTCTGATGTAACATGTGATACATACAAAGAATATAG
TTTAATATGTATTGAAATAAAACACAATAAAATT
```

FIGURE 214

MPEMPEDMEQEEVNIPNRRVLVTGATGLLGRAVHKEFQQNNWHAVGCGFRRARPKFEQVN
LLDSNAVHHIIHDFQPHVIVHCAAERRPDVVENQPDAASQLNVDASGNLAKEAAAVGAFL
IYISSDYVFDGTNPPYREEDIPAPLNLYGKTKLDGEKAVLENNLGAAVLRIPILYGEVEK
LEESAVTVMFDKVQFSNKSANMDHWQQRFPTHVKDVATVCRQLAEKRMLDPSIKGTFHWS
GNEQMTKYEMACAIADAFNLPSSHLRPITDSPVLGAQRPRNAQLDCSKLETLGIGQRTPF
RIGIKESLWPFLIDKRWRQTVFH

Signal peptide:
amino acids 1-30

Transmembrane domain:
amino acids 105-127

N-glycosylation site:
amino acids 197-201

N-myristoylation site:
amino acids 303-309

Short-chain dehydrogenases/reductases family proteins:
amino acids 18-30

FIGURE 215

```
GTGAATGTGAGGGTTTGATGACTTTCAGATGTCTAGGAACCAGAGTGGGTGCAGGGGCCC
CAGGCAGGGCTGATTCTTGGGCGGAGGAGAGTAGGGTAAAGGGTTCTGCATGAGCTCCTT
AAAGGACAAAGGTAACAGAGCCAGCGAGAGAGCTCGAGGGGAGACTTTGACTTCAAGCCA
CAGAATTGGTGGAAGTGTGCGCGCCGCCGCCGTCGCTCCTGCAGCGCTGTCGACCTA
GCCGCTAGCATCTTCCCGAGCACCGGGATCCCGGGGTAGGAGGCGACGCGGGCGAGCACC
AGCGCCAGCCGGCTGCGGCTGCCCACACGGCTCACCATGGGCTCCGGGCGCCGGGCGCTG
TCCGCGGTGCCGGCCGTGCTGCTGGTCCTCACGCTGCCGGGGCTGCCCGTCTGGGCACAG
AACGACACGGAGCCCATCGTGCTGGAGGGCAAGTGTCTGGTGGTGTGCGACTCGAACCCG
GCCACGGACTCCAAGGGCTCCTCTTCCTCCCCGCTGGGGATATCGGTCCGGGCGGCCAAC
TCCAAGGTCGCCTTCTCGGCGGTGCGGAGCACCAACCACGAGCCATCCGAGATGAGCAAC
AAGACGCGCATCATTTACTTCGATCAGATCCTGGTGAATGTGGGTAATTTTTTCACATTG
GAGTCTGTCTTTGTAGCACCAAGAAAAGGAATTTACAGTTTCAGTTTTCACGTGATTAAA
GTCTACCAGAGCCAAACTATCCAGGTTAACTTGATGTTAAATGGAAAACCAGTAATATCT
GCCTTTGCGGGGACAAAGATGTTACTCGTGAAGCTGCCACGAATGGTGTCCTGCTCTAC
CTAGATAAAGAGGATAAGGTTTACCTAAAACTGGAGAAAGGTAATTTGGTTGGAGGCTGG
CAGTATTCCACGTTTTCTGGCTTTCTGGTGTTCCCCCTATAGGATTCAATTTCTCCATGA
TGTTCATCCAGGTGAGGGATGACCCACTCCTGAGTTATTGGAAGATCATTTTTTCATCAT
TGGATTGATGTCTTTTATTGGTTTCTCATGGGTGGATATGGATTCTAAGGATTCTAGCCT
GTCTGAACCAATACAAAATTTCACAGATTATTTGTGTGTGTCTGTTTCAGTATATTTGGA
TTGGGACTCTAAGCAGATAATACCTATGCTTAAATGTAACAGTCAAAAGCTGTCTGCAAG
ACTTATTCTGAATTTCATTTCCTGGGATTACTGAATTAGTTACAGATGTGGAATTTTATT
TGTTTAGTTTTAAAAGACTGGCAACCAGGTCTAAGGATTAGAAAACTCTAAAGTTCTGAC
TTCAATCAACGGTTAGTGTGATACTGCCAAAGAACTGTATACTGTGTTAATATATTGATT
ATATTTGTTTTTATTCCTTTGGAATTAGTTTGTTTGGTTCTTGTAAAAAACTTGGATTTT
TTTTTTCAGTAACTGGTATTATGTTTTCTCTTAAAATAAGGTAATGAATGGCTTGCCCAC
AAATTTACCTTGACTACGATATCATCGACATGACTTCTCTCAAAAAAAAAGAATGCTTCA
TAGTTGTATTTTAATTGTATATGTGAAAGAGTCATATTTTCCAAGTTATATTTTCTAAGA
AGAAGAATAGATCATAAATCTGACAAGGAAAAGTTGCTTACCCAAAATCTAAGTGCTCA
ATCCCTGAGCCTCAGCAAAACAGCTCCCCTCCGAGGGAAATCTTATACTTTATTGCTCAA
CTTTAATTAAAATGATTGATAATAACCACTTTATTAAAAACCTAAGGTTTTTTTTTTTTC
CGTAGACATGACCACTTTATTAACTGGTGGTGGGATGCTGTTGTTTCTAATTATACCTAT
TTTTCAAGGCTTCTGTTGTATTTGAAGTATCATCTGGTTTTGCCTTAACTCTTTAAATTG
TATATATTTATCTGTTTAGCTAATATTAAATTCAAATATCCCATATCTAAATTTAGTGCA
ATATCTTGTCTTTTGTATAGGTCATATGAATTCATAAAATTATTTATGTCTGTTATAGAA
TAAAGATTAATATATGTTAAAAAAA
```

FIGURE 216

MGSGRRALSAVPAVLLVLTLPGLPVWAQNDTEPIVLEGKCLVVCDSNPATDSKGSSSSPL
GISVRAANSKVAFSAVRSTNHEPSEMSNKTRIIYFDQILVNVGNFFTLESVFVAPRKGIY
SFSFHVIKVYQSQTIQVNLMLNGKPVISAFAGDKDVTREAATNGVLLYLDKEDKVYLKLE
KGNLVGGWQYSTFSGFLVFPL

Signal peptide:
amino acids 1-27

FIGURE 217

```
CGGCAACCAGCCGCCGCCACCACCGCTGCCACTGCCGCCCTGCCGGGGCCATGTTCGCTC
TGGGCTTGCCCTTCTTGGTGCTCTTGGTGGCCTCGGTCGAGAGCCATCTGGGGGTTCTGG
GGCCCAAGAACGTCTCGCAGAAAGACGCCGAGTTTGAGCGCACCTACGTGGACGAGGTCA
ACAGCGAGCTGGTCAACATCTACACCTTCAACCATACTGTGACCCGCAACAGGACAGAGG
GCGTGCGTGTGTCTGTGAACGTCCTGAACAAGCAGAAGGGGGCGCCGTTGCTGTTTGTGG
TCCGCCAGAAGGAGGCTGTGGTGTCCTTCCAGGTGCCCCTAATCCTGCGAGGGATGTTTC
AGCGCAAGTACCTCTACCAAAAGTGGAACGAACCCTGTGTCAGCCCCCACCAAGAATG
AGTCGGAGATTCAGTTCTTCTACGTGGATGTGTCCACCCTGTCACCAGTCAACACCACAT
ACCAGCTCCGGGTCAGCCGCATGGACGATTTTGTGCTCAGGACTGGGGAGCAGTTCAGCT
TCAATACCACAGCAGCACAGCCCCAGTACTTCAAGTATGAGTTCCCTGAAGGCGTGGACT
CGGTAATTGTCAAGGTGACCTCCAACAAGGCCTTCCCCTGCTCAGTCATCTCCATTCAGG
ATGTGCTGTGTCCTGTCTATGACCTGGACAACAACGTAGCCTTCATCGGCATGTACCAGA
CGATGACCAAGAAGGCGGCCATCACCGTACAGCGCAAAGACTTCCCCAGCAACAGCTTTT
ATGTGGTGGTGGTGGTGAAGACCGAAGACCAAGCCTGCGGGGGCTCCCTGCCTTTCTACC
CCTTCGCAGAAGATGAACCGGTCGATCAAGGGCACCGCCAGAAAACCCTGTCAGTGCTGG
TGTCTCAAGCAGTCACGTCTGAGGCATACGTCAGTGGGATGCTCTTTTGCCTGGGTATAT
TTCTCTCCTTTTACCTGCTGACCGTCCTCCTGGCCTGCTGGGAGAACTGGAGGCAGAAGA
AGAAGACCCTGCTGGTGGCCATTGACCGAGCCTGCCCAGAAAGCGGTCACCCTCGAGTCC
TGGCTGATTCTTTTCCTGGCAGTTCCCCTTATGAGGGTTACAACTATGGCTCCTTTGAGA
ATGTTTCTGGATCTACCGATGGTCTGGTTGACAGCGCTGGCACTGGGGACCTCTCTTACG
GTTACCAGGGCCGCTCCTTTGAACCTGTAGGTACTCGGCCCCGAGTGGACTCCATGAGCT
CTGTGGAGGAGGATGACTACGACACATTGACCGACATCGATTCCGACAAGAATGTCATTC
GCACCAAGCAATACCTCTATGTGGCTGACCTGGCACGGAAGGACAAGCGTGTTCTGCGGA
AAAAGTACCAGATCTACTTCTGGAACATTGCCACCATTGCTGTCTTCTATGCCCTTCCTG
TGGTGCAGCTGGTGATCACCTACCAGACGGTGGTGAATGTCACAGGGAATCAGGACATCT
GCTACTACAACTTCCTCTGCGCCCACCCACTGGGCAATCTCAGCGCCTTCAACAACATCC
TCAGCAACCTGGGGTACATCCTGCTGGGGCTGCTTTTCCTGCTCATCATCCTGCAACGGG
AGATCAACCACAACCGGGCCCTGCTGCGCAATGACCTCTGTGCCCTGGAATGTGGGATCC
CCAAACACTTTGGGCTTTTCTACGCCATGGGCACAGCCCTGATGATGGAGGGGCTGCTCA
GTGCTTGCTATCATGTGTGCCCCAACTATACCAATTTCCAGTTTGACACATCGTTCATGT
ACATGATCGCCGGACTCTGCATGCTGAAGCTCTACCAGAAGCGGCACCCGGACATCAACG
CCAGCGCCTACAGTGCCTACGCCTGCCTGGCCATTGTCATCTTCTTCTCTGTGCTGGGCG
TGGTCTTTGGCAAAGGGAACACGGCGTTCTGGATCGTCTTCTCCATCATTCACATCATCG
CCACCCTGCTCCTCAGCACGCAGCTCTATTACATGGGCCGGTGGAAACTGGACTCGGGGA
TCTTCCGCCGCATCCTCCACGTGCTCTACACAGACTGCATCCGGCAGTGCAGCGGGCCGC
TCTACGTGGACCGCATGGTGCTGCTGGTCATGGGCAACGTCATCAACTGGTCGCTGGCTG
CCTATGGGCTTATCATGCGCCCCAATGATTTCGCTTCCTACTTGTTGGCCATTGGCATCT
GCAACCTGCTCCTTTACTTCGCCTTCTACATCATCATGAAGCTCCGGAGTGGGGAGAGGA
TCAAGCTCATCCCCCTGCTCTGCATCGTTTGCACCTCCGTGGTCTGGGGCTTCGCGCTCT
TCTTCTTCTTCCAGGGACTCAGCACCTGGCAGAAAACCCCTGCAGAGTCGAGGGAGCACA
ACCGGGACTGCATCCTCCTCGACTTCTTTGACGACCACGACATCTGGCACTTCCTCTCCT
CCATCGCCATGTTCGGGTCCTTCCTGGTGTTGCTGACACTGGATGACGACCTGGATACTG
TGCAGCGGGACAAGATCTATGTCTTCTAGCAGGAGCTGGGCCCTTCGCTTCACCTCAAGG
GGCCCTGAGCTCCTTTGTGTCATAGACCGGTCACTCTGTCGTGCTGTGGGGATGAGTCCC
AGCACCGCTGCCCAGCACTGGATGGCAGCAGGACAGCCAGGTCTAGCTTAGGCTTGGCCT
GGGACAGCCATGGGTGGCATGGAACCTTGCAGCTGCCCTCTGCCGAGGAGCAGGCCTGC
TCCCCTGGAACCCCCAGATGTTGGCCAAATTGCTGCTTTCTTCTCAGTGTTGGGGCCTTC
```

FIGURE 217
(continued)

```
CATGGGCCCCTGTCCTTTGGCTCTCCATTTGTCCCTTTGCAAGAGGAAGGATGGAAGGGA
CACCCTCCCCATTTCATGCCTTGCATTTTGCCCGTCCTCCTCCCCACAATGCCCCAGCCT
GGGACCTAAGGCCTCTTTTTCCTCCCATACTCCCACTCCAGGGCCTAGTCTGGGGCCTGA
ATCTCTGTCCTGTATCAGGGCCCCAGTTCTCTTTGGGCTGTCCCTGGCTGCCATCACTGC
CCATTCCAGTCAGCCAGGATGGATGGGGGTATGAGATTTTGGGGGTTGGCCAGCTGGTGC
CAGACTTTTGGTGCTAAGGCCTGCAAGGGGCCTGGGGCAGTGCGTATTCTCTTCCCTCTG
ACCTGTGCTCAGGGCTGGCTCTTTAGCAATGCGCTCAGCCCAATTTGAGAACCGCCTTCT
GATTCAAGAGGCTGAATTCAGAGGTCACCTCTTCATCCCATCAGCTCCCAGACTGATGCC
AGCACCAGGACTGGAGGGAGAAGCGCCTCACCCCTTCCCTTCCTTCTTTCCAGGCCCTTA
GTCTTGCCAAACCCCAGCTGGTGGCCTTTCAGTGCCATTGACACTGCCCAAGAATGTCCA
GGGGCAAAGGAGGGATGATACAGAGTTCAGCCCGTTCTGCCTCCACAGCTGTGGGCACCC
CAGTGCCTACCTTAGAAAGGGGCTTCAGGAAGGGATGTGCTGTTTCCCTCTACGTGCCCA
GTCCTAGCCTCGCTCTAGGACCCAGGGCTGGCTTCTAAGTTTCCGTCCAGTCTTCAGGCA
AGTTCTGTGTTAGTCATGCACACACATACCTATGAAACCTTGGAGTTTACAAAGAATTGC
CCCAGCTCTGGGCACCCTGGCCACCCTGGTCCTTGGATCCCCTTCGTCCCACCTGGTCCA
CCCCAGATGCTGAGGATGGGGGAGCTCAGGCGGGCCTCTGCTTTGGGGATGGGAATGTG
TTTTTCTCCCAAACTTGTTTTTATAGCTCTGCTTGAAGGGCTGGGAGATGAGGTGGGTCT
GGATCTTTTCTCAGAGCGTCTCCATGCTATGGTTGCATTTCCGTTTTCTATGAATGAATT
TGCATTCAATAAACAACCAGACTCAAAAAAAAAAAAAA
```

FIGURE 218

```
MFALGLPFLVLLVASVESHLGVLGPKNVSQKDAEFERTYVDEVNSELVNIYTFNHTVTRN
RTEGVRVSVNVLNKQKGAPLLFVVRQKEAVVSFQVPLILRGMFQRKYLYQKVERTLCQPP
TKNESEIQFFYVDVSTLSPVNTTYQLRVSRMDDFVLRTGEQFSFNTTAAQPQYFKYEFPE
GVDSVIVKVTSNKAFPCSVISIQDVLCPVYDLDNNVAFIGMYQTMTKKAAITVQRKDFPS
NSFYVVVVVKTEDQACGGSLPFYPFAEDEPVDQGHRQKTLSVLVSQAVTSEAYVSGMLFC
LGIFLSFYLLTVLLACWENWRQKKKTLLVAIDRACPESGHPRVLADSFPGSSPYEGYNYG
SFENVSGSTDGLVDSAGTGDLSYGYQGRSFEPVGTRPRVDSMSSVEEDDYDTLTDIDSDK
NVIRTKQYLYVADLARKDKRVLRKKYQIYFWNIATIAVFYALPVVQLVITYQTVVNVTGN
QDICYYNFLCAHPLGNLSAFNNILSNLGYILLGLLFLLIILQREINHNRALLRNDLCALE
CGIPKHFGLFYAMGTALMMEGLLSACYHVCPNYTNFQFDTSFMYMIAGLCMLKLYQKRHP
DINASAYSAYACLAIVIFFSVLGVVFGKGNTAFWIVFSIIHIIATLLLSTQLYYMGRWKL
DSGIFRRILHVLYTDCIRQCSGPLYVDRMVLLVMGNVINWSLAAYGLIMRPNDFASYLLA
IGICNLLLYFAFYIIMKLRSGERIKLIPLLCIVCTSVVWGFALFFFFQGLSTWQKTPAES
REHNRDCILLDFFDDHDIWHFLSSIAMFGSFLVLLTLDDDLDTVQRDKIYVF
```

Important features of the protein:
Signal peptide:
amino acids 1-18

Transmembrane domains:
amino acids 292-317, 451-470, 501-520, 607-627, 751-770

Leucine zipper pattern:
amino acids 497-518

N-glycosylation sites:
amino acids 27-30, 54-57, 60-63, 123-126, 141-144, 165-168, 364-367, 476-479, 496-499, 572-575, 603-606, 699-702

FIGURE 219

AATTTTTCACCAGAGTAAACTTGAGAAACCAACTGGACCTTGAGTATTGTACATTTTGCC
TCGTGGACCCAAAGGTAGCAATCTGAAACATGAGGAGTACGATTCTACTGTTTTGTCTTC
TAGGATCAACTCGGTCATTACCACAGCTCAAACCTGCTTTGGGACTCCCTCCCACAAAAC
TGGCTCCGGATCAGGGAACACTACCAAACCAACAGCAGTCAAATCAGGTCTTTCCTTCTT
TAAGTCTGATACCATTAACACAGATGCTCACACTGGGGCCAGATCTGCATCTGTTAAATC
CTGCTGCAGGAATGACACCTGGTACCCAGACCCACCCATTGACCCTGGGAGGGTTGAATG
TACAACAGCAACTGCACCCACATGTGTTACCATTTTTGTCACACAACTTGGAGCCCAGG
GCACTATCCTAAGCTCAGAGGAATTGCCACAAATCTTCACGAGCCTCATCATCCATTCCT
TGTTCCCGGGAGGCATCCTGCCCACCAGTCAGGCAGGGCTAATCCAGATGTCCAGGATG
GAAGCCTTCCAGCAGGAGGAGCAGGTGTAAATCCTGCCACCCAGGGAACCCCAGCAGGCC
GCCTCCCAACTCCCAGTGGCACAGATGACGACTTTGCAGTGACCACCCCTGCAGGCATCC
AAAGGAGCACACATGCCATCGAGGAAGCCACCACAGAATCAGCAAATGGAATTCAGTAAG
CTGTTTCAAATTTTTTCAACTAAGCTGCCTCGAATTTGGTGATACATGTGAATCTTTATC
ATTGATTATATTATGGAATAGATTGAGACACATTGGATAGTCTTAGAAGAAATTAATTCT
TAATTTACCTGAAAATATTCTTGAAATTTCAGAAAATATGTTCTATGTAGAGAATCCCAA
CTTTTAAAAACAATAATTCAATGGATAAATCTGTCTTTGAAATATAACATTATGCTGCCT
GGATGATATGCATATTAAAACATATTTGGAAACTGGAAAAAAAAAAAAAAAAAAAAAAA
AAAAAAAAAAAAAAAAAAAAAAAAAAAAAAAAAAAAAAAAAAAAAAAAAAAAA

FIGURE 220

MRSTILLFCLLGSTRSLPQLKPALGLPPTKLAPDQGTLPNQQQSNQVFPSLSLIPLTQML
TLGPDLHLLNPAAGMTPGTQTHPLTLGGLNVQQQLHPHVLPIFVTQLGAQGTILSSEELP
QIFTSLIIHSLFPGGILPTSQAGANPDVQDGSLPAGGAGVNPATQGTPAGRLPTPSGTDD
DFAVTTPAGIQRSTHAIEEATTESANGIQ

Signal peptide:
amino acids 1-16

FIGURE 221

```
GACTTTGCTTGAATGTTTACATTTTCTGCTCGCTGTCCTACATATCACAATATAGTGTTC
ACGTTTTGTTAAAACTTTGGGGTGTCAGGAGTTGAGCTTGCTCAGCAAGCCAGCATGGCT
AGGATGAGCTTTGTTATAGCAGCTTGCCAATTGGTGCTGGGCCTACTAATGACTTCATTA
ACCGAGTCTTCCATACAGAATAGTGAGTGTCCACAACTTTGCGTATGTGAAATTCGTCCC
TGGTTTACCCCACAGTCAACTTACAGAGAAGCCACCACTGTTGATTGCAATGACCTCCGC
TTAACAAGGATTCCCAGTAACCTCTCTAGTGACACACAAGTGCTTCTCTTACAGAGCAAT
AACATCGCGAAGACTGTGGATGAGCTGCAGCAGCTTTTCAACTTGACTGAACTAGATTTC
TCCCAAAACAACTTTACTAACATTAAGGAGGTCGGGCTGGCAAACCTAACCCAGCTCACA
ACGCTGCATTTGGAGGAAAATCAGATTACCGAGATGACTGATTACTGTCTACAAGACCTC
AGCAACCTTCAAGAACTCTACATCAACCACAACCAAATTAGCACTATTTCTGCTCATGCT
TTTGCAGGCTTAAAAAATCTATTAAGGCTCCACCTGAACTCCAACAAATTGAAAGTTATT
GATAGTCGCTGGTTTGATTCTACACCCAACCTGGAAATTCTCATGATCGGAGAAAACCCT
GTGATTGGAATTCTGGATATGAACTTCAAACCCCTCGCAAATTTGAGAAGCTTAGTTTTG
GCAGGAATGTATCTCACTGATATTCCTGGAAATGCTTTGGTGGGTCTGGATAGCCTTGAG
AGCCTGTCTTTTTATGATAACAAACTGGTTAAAGTCCCTCAACTTGCCCTGCAAAAAGTT
CCAAATTTGAAATTCTTAGACCTCAACAAAAACCCCATTCACAAATCCAAGAAGGGGAC
TTCAAAAATATGCTTCGGTTAAAAGAACTGGGAATCAACAATATGGGCGAGCTCGTTTCT
GTCGACCGCTATGCCCTGGATAACTTGCCTGAACTCACAAAGCTGGAAGCCACCAATAAC
CCTAAACTCTCTTACATCCACCGCTTGGCTTTCCGAAGTGTCCCTGCTCTGGAAAGCTTG
ATGCTGAACAACAATGCCTTGAATGCCATTTACCAAAAGACAGTCGAATCCCTCCCCAAT
CTGCGTGAGATCAGTATCCATAGCAATCCCCTCAGGTGTGACTGTGTGATCCACTGGATT
AACTCCAACAAAACCAACATCCGCTTCATGGAGCCCCTGTCCATGTTCTGTGCCATGCCG
CCCGAATATAAAGGGCACCAGGTGAAGGAAGTTTTAATCCAGGATTCGAGTGAACAGTGC
CTCCCAATGATATCTCACGACAGCTTCCCAAATCGTTTAAACGTGGATATCGGCACGACG
GTTTTCCTAGACTGTCGAGCCATGGCTGAGCCAGAACCTGAAATTTACTGGGTCACTCCC
ATTGGAAATAAGATAACTGTGGAAACCCTTTCAGATAAATACAAGCTAAGTAGCGAAGGT
ACCTTGGAAATATCTAACATACAAATTGAAGACTCAGGAAGATACACATGTGTTGCCCAG
AATGTCCAAGGGGCAGACACTCGGGTGGCAACAATTAAGGTTAACGGGACCCTTCTGGAT
GGTACCCAGGTGCTAAAAATATACGTCAAGCAGACAGAATCCCATTCCATCTTAGTGTCC
TGGAAAGTTAATTCCAATGTCATGACGTCAAACTTAAAATGGTCGTCTGCCACCATGAAG
ATTGATAACCCTCACATAACATATACTGCCAGGGTCCCAGTCGATGTCCATGAATACAAC
CTAACGCATCTGCAGCCTTCCACAGATTATGAAGTGTGTCTCACAGTGTCCAATATTCAT
CAGCAGACTCAAAAGTCATGCGTAAATGTCACAACCAAAAATGCCGCCTTCGCAGTGGAC
ATCTCTGATCAAGAAACCAGTACAGCCCTTGCTGCAGTAATGGGGTCTATGTTTGCCGTC
ATTAGCCTTGCGTCCATTGCTGTGTACTTTGCCAAAAGATTTAAGAGAAAAAACTACCAC
CACTCATTAAAAAAGTATATGCAAAAAACCTCTTCAATCCCACTAAATGAGCTGTACCCA
CCACTCATTAACCTCTGGGAAGGTGACAGCGAGAAGACAAAGATGGTTCTGCAGACACC
AAGCCAACCCAGGTCGACACATCCAGAAGCTATTACATGTGGTAACTCAGAGGATATTTT
GCTTCTGGTAGTAAGGAGCACAAAGACGTTTTTGCTTTATTCTGCAAAAGTGAACAAGTT
GAAGACTTTTGTATTTTTGACTTTGCTAGTTTGTGGCAGAGTGGAGAGGACGGGTGGATA
TTTCAAATTTTTTTAGTATAGCGTATCGCAAGGGTTTGACACGGCTGCCAGCGACTCTAG
GCTTCCAGTCTGTGTTTGGTTTTATTCTTATCATTATTATGATTGTTATTATATTATTA
TTTTATTTTAGTTGTTGTGCTAAACTCAATAATGCTGTTCTAACTACAGTGCTCAATAAA
ATGATTAATGACAGGAAAAAAAAAAAAAAAAAAAAAAAAAAAAAAAAAAAAAAAAAAAA
AAAAAAAAAAAAAAAAAAAAAAAAAA
```

FIGURE 222

```
MARMSFVIAACQLVLGLLMTSLTESSIQNSECPQLCVCEIRPWFTPQSTYREATTVDCND
LRLTRIPSNLSSDTQVLLLQSNNIAKTVDELQQLFNLTELDFSQNNFTNIKEVGLANLTQ
LTTLHLEENQITEMTDYCLQDLSNLQELYINHNQISTISAHAFAGLKNLLRLHLNSNKLK
VIDSRWFDSTPNLEILMIGENPVIGILDMNFKPLANLRSLVLAGMYLTDIPGNALVGLDS
LESLSFYDNKLVKVPQLALQKVPNLKFLDLNKNPIHKIQEGDFKNMLRLKELGINNMGEL
VSVDRYALDNLPELTKLEATNNPKLSYIHRLAFRSVPALESLMLNNNALNAIYQKTVESL
PNLREISIHSNPLRCDCVIHWINSNKTNIRFMEPLSMFCAMPPEYKGHQVKEVLIQDSSE
QCLPMISHDSFPNRLNVDIGTTVFLDCRAMAEPEPEIYWVTPIGNKITVETLSDKYKLSS
EGTLEISNIQIEDSGRYTCVAQNVQGADTRVATIKVNGTLLDGTQVLKIYVKQTESHSIL
VSWKVNSNVMTSNLKWSSATMKIDNPHITYTARVPVDVHEYNLTHLQPSTDYEVCLTVSN
IHQQTQKSCVNVTTKNAAFAVDISDQETSTALAAVMGSMFAVISLASIAVYFAKRFKRKN
YHHSLKKYMQKTSSIPLNELYPPLINLWEGDSEKDKDGSADTKPTQVDTSRSYYMW
```

Important features:
Signal peptide:
Amino acids 1-25

Transmembrane domain:
Amino acids 508-530

N-glycosylation sites:
Amino acids 69-73;96-100;106-110;117-121;385-389;517-521;
582-586;611-615

Tyrosine kinase phosphorylation site:
Amino acids 573-582

N-myristoylation sites:
Amino acids 16-22;224-230;464-470;637-643;698-704

FIGURE 223

CAACCATGCAAGGACAGGGCAGGAGAAGAGGAACCTGCAAAGACATATTTTGTTCCAAAA
TGGCATCTTACCTTTATGGAGTACTCTTTGCTGTTGGCCTCTGTGCTCCAATCTACTGTG
TGTCCCCGGCCAATGCCCCCAGTGCATACCCCGCCCTTCCTCCACAAAGAGCACCCCTG
CCTCACAGGTGTATTCCCTCAACACCGACTTTGCCTTCCGCCTATACCGCAGGCTGGTTT
TGGAGACCCCGAGTCAGAACATCTTCTTCTCCCTGTGAGTGTCTCCACTTCCCTGGCCA
TGCTCTCCCTTGGGGCCCACTCAGTCACCAAGACCCAGATTCTCCAGGGCCTGGGCTTCA
ACCTCACACACACACCAGAGTCTGCCATCCACCAGGGCTTCCAGCACCTGGTTCACTCAC
TGACTGTTCCCAGCAAAGACCTGACCTTGAAGATGGGAAGTGCCCTCTTCGTCAAGAAGG
AGCTGCAGCTGCAGGCAAATTTCTTGGGCAATGTCAAGAGGCTGTATGAAGCAGAAGTCT
TTTCTACAGATTTCTCCAACCCCTCCATTGCCCAGGCGAGGATCAACAGCCATGTGAAAA
AGAAGACCCAAGGGAAGGTTGTAGACATAATCCAAGGCCTTGACCTTCTGACGGCCATGG
TTCTGGTGAATCACATTTTCTTTAAAGCCAAGTGGGAGAAGCCCTTTCACCTTGAATATA
CAAGAAAGAACTTCCCATTCCTGGTGGGCGAGCAGGTCACTGTGCAAGTCCCCATGATGC
ACCAGAAAGAGCAGTTCGCTTTTGGGGTGGATACAGAGCTGAACTGCTTTGTGCTGCAGA
TGGATTACAAGGGAGATGCCGTGGCCTTCTTTGTCCTCCCTAGCAAGGGCAAGATGAGGC
AACTGGAACAGGCCTTGTCAGCCAGAACACTGATAAAGTGGAGCCACTCACTCCAGAAAA
GGTGGATAGAGGTGTTCATCCCCAGATTTTCCATTTCTGCCTCCTACAATCTGGAAACCA
TCCTCCCGAAGATGGGCATCCAAAATGCCTTTGACAAAAATGCTGATTTTTCTGGAATTG
CAAAGAGAGACTCCCTGCAGGTTTCTAAAGCAACCCACAAGGCTGTGCTGGATGTCAGTG
AAGAGGGCACTGAGGCCACAGCAGCTACCACCACCAAGTTCATAGTCCGATCGAAGGATG
GTCCCTCTTACTTCACTGTCTCCTTCAATAGGACCTTCCTGATGATGATTACAAATAAAG
CCACAGACGGTATTCTCTTTCTAGGGAAAGTGGAAAATCCACTAAATCCTAGGTGGGAA
ATGGCCTGTTAACTGATGGCACATTGCTAATGCACAAGAAATAACAAACCACATCCCTCT
TTCTGTTCTGAGGGTGCATTTGACCCCAGTGGAGCTGGATTCGCTGGCAGGGATGCCACT
TCCAAGGCTCAATCACCAAACCATCAACAGGGACCCCAGTCACAAGCCAACACCCATTAA
CCCCAGTCAGTGCCCTTTTCCACAAATTCTCCCAGGTAACTAGCTTCATGGGATGTTGCT
GGGTTACCATATTTCCATTCCTTGGGGCTCCCAGGAATGGAAATACGCCAACCCAGGTTA
GGCACCTCTATTGCAGAATTACAATAACACATTCAATAAAACTAAAATATGAATTCAAAA
AAAAAAAAAAAAAAAAAAAAAAAAAAAAAAAAAAAAAAAAAAAAAAAAAAAAAAAAAAAA
AAA

FIGURE 224

MASYLYGVLFAVGLCAPIYCVSPANAPSAYPRPSSTKSTPASQVYSLNTDFAFRLYRRLV
LETPSQNIFFSPVSVSTSLAMLSLGAHSVTKTQILQGLGFNLTHTPESAIHQGFQHLVHS
LTVPSKDLTLKMGSALFVKKELQLQANFLGNVKRLYEAEVFSTDFSNPSIAQARINSHVK
KKTQGKVVDIIQGLDLLTAMVLVNHIFFKAKWEKPFHLEYTRKNFPFLVGEQVTVQVPMM
HQKEQFAFGVDTELNCFVLQMDYKGDAVAFFVLPSKGKMRQLEQALSARTLIKWSHSLQK
RWIEVFIPRFSISASYNLETILPKMGIQNAFDKNADFSGIAKRDSLQVSKATHKAVLDVS
EEGTEATAATTTKFIVRSKDGPSYFTVSFNRTFLMMITNKATDGILFLGKVENPTKS

Signal peptide:
amino acids 1-20

FIGURE 225

GGGAGAGAGGATAAATAGCAGCGTGGCTTCCCTGGCTCCTCTCTGCATCCTTCCCGACCT
TCCCAGCAATATGCATCTTGCACGTCTGGTCGGCTCCTGCTCCCTCCTTCTGCTACTGGG
GGCCCTGTCTGGATGGGCGGCCAGCGATGACCCCATTGAGAAGGTCATTGAAGGGATCAA
CCGAGGGCTGAGCAATGCAGAGAGAGAGGTGGGCAAGGCCCTGGATGGCATCAACAGTGG
AATCACGCATGCCGGAAGGGAAGTGGAGAAGGTTTTCAACGGACTTAGCAACATGGGGAG
CCACACCGGCAAGGAGTTGGACAAAGGCGTCCAGGGGCTCAACCACGGCATGGACAAGGT
TGCCCATGAGATCAACCATGGTATTGGACAAGCAGGAAAGGAAGCAGAGAAGCTTGGCCA
TGGGGTCAACAACGCTGCTGGACAGGCCGGGAAGGAAGCAGACAAAGCGGTCCAAGGGTT
CCACACTGGGGTCCACCAGGCTGGGAAGGAAGCAGAGAAACTTGGCCAAGGGGTCAACCA
TGCTGCTGACCAGGCTGGAAAGGAAGTGGAGAAGCTTGGCCAAGGTGCCCACCATGCTGC
TGGCCAGGCCGGGAAGGAGCTGCAGAATGCTCATAATGGGGTCAACCAAGCCAGCAAGGA
GGCCAACCAGCTGCTGAATGGCAACCATCAAAGCGGATCTTCCAGCCATCAAGGAGGGGC
CACAACCACGCCGTTAGCCTCTGGGCCTCAGTCAACACGCCTTTCATCAACCTTCCCGC
CCTGTGGAGGAGCGTCGCCAACATCATGCCCTAAACTGGCATCCGGCCTTGCTGGGAGAA
TAATGTCGCCGTTGTCACATCAGCTGACATGACCTGGAGGGGTTGGGGGTGGGGACAGG
TTTCTGAAATCCCTGAAGGGGGTTGTACTGGGATTTGTAATAAACTTGATACACCA

FIGURE 226

MHLARLVGSCSLLLLLGALSGWAASDDPIEKVIEGINRGLSNAEREVGKALDGINSGITH
AGREVEKVFNGLSNMGSHTGKELDKGVQGLNHGMDKVAHEINHGIGQAGKEAEKLGHGVN
NAAGQAGKEADKAVQGFHTGVHQAGKEAEKLGQGVNHAADQAGKEVEKLGQGAHHAAGQA
GKELQNAHNGVNQASKEANQLLNGNHQSGSSSHQGGATTTPLASGASVNTPFINLPALWR
SVANIMP

Important features of the protein:
Signal peptide:
amino acids 1-25

Homologous region to circumsporozoite (CS) repeats:
amino acids 35-225

FIGURE 227

GAAGTAGAGGTGTTGTGCTGAGCGGCGCTCGGCGAACTGTGTGGACCGTCTGCTGGGACT
CCGGCCCTGCGTCCGCTCAGCCCCGTGGCCCCGCGCACCTACTGCCATGGAGACGCGGCC
TCGTCTCGGGGCCACCTGTTTGCTGGGCTTCAGTTTCCTGCTCCTCGTCATCTCTTCTGA
TGGACATAATGGGCTTGGAAAGGGTTTTGGAGATCATATTCATTGGAGGACACTGGAAGA
TGGGAAGAAAGAAGCAGCTGCCAGTGGACTGCCCCTGATGGTGATTATTCATAAATCCTG
GTGTGGAGCTTGCAAAGCTCTAAAGCCCAAATTTGCAGAATCTACGGAAATTTCAGAACT
CTCCCATAATTTTGTTATGGTAAATCTTGAGGATGAAGAGGAACCCAAAGATGAAGATTT
CAGCCCTGACGGGGGTTATATTCCACGAATCCTTTTTCTGGATCCCAGTGGCAAGGTGCA
TCCTGAAATCATCAATGAGAATGGAAACCCCAGCTACAAGTATTTTTATGTCAGTGCCGA
GCAAGTTGTTCAGGGGATGAAGGAAGCTCAGGAAAGGCTGACGGGTGATGCCTTCAGAAA
GAAACATCTTGAAGATGAATTGTAACATGAATGTGCCCCTTCTTTCATCAGAGTTAGTGT
TCTGGAAGGAAAGCAGCAGGGAAGGGAATATTGAGGAATCATCTAGAACAATTAAGCCGA
CCAGGAAACCTCATTCCTACCTACACTGGAAGGAGCGCTCTCACTGTGGAAGAGTTCTGC
TAACAGAAGCTGGTCTGCATGTTTGTGGATCCAGCGGAGAGTGGCAGACTTTCTTCTCCT
TTTCCCTCTCACCTAAATGTCAACTTGTCATTGAATGTAAAGAATGAAACCTTCTGACAC
AAAA

FIGURE 228

METRPRLGATCLLGFSFLLLVISSDGHNGLGKGFGDHIHWRTLEDGKKEAAASGLPLMVI
IHKSWCGACKALKPKFAESTEISELSHNFVMVNLEDEEEPKDEDFSPDGGYIPRILFLDP
SGKVHPEIINENGNPSYKYFYVSAEQVVQGMKEAQERLTGDAFRKKHLEDEL

Signal peptide:
Amino acids 1-23

Thioredoxin family proteins Homology Block:
Amino acids 58-75

FIGURE 229

```
CCCACGCGTCCGCCCACGCGTCCGGGTGCCACTCGCGCGCCGGCCGCGCTCCGGGCTTCT
CTTTTCCCTCCGACGCGCCACGGCTGCCCAGACATTCCGGCTGCCGGGTCTGGAGAGCTC
CCCGAACCCCTCCGCGGAGAGGAGCGAGGCGGCGCCAGGGTGGCCCCCGGGGCGCGCTTG
GTCTCGGAGAAGCGGGGACGAGGCCGGAGGATGAGCGACTGAGGCGACGCGGGCACTGA
CGCGAGTTGGGGCCGCGACTACCGGCAGCTGACAGCGCGATGAGCGACTCCCCAGAGACG
CCCTAGCCCGGTGTGCGCGCCAGGCGGAGCGCGCAGGTGGGGCTGGGCTGTTAGTGGTCC
GCCCCACGCGGGTCGCCGGCCGGCCCAGGATGGGCGCTGGCAACCCGGGCCCGCGCCCGC
CGCTGCTACCCCTGCGCCCGCTGCGAGCCCGGCGTCCGGCCCGCGCCCTGCGCTCATGGA
CGGCGGCTCCCGGCTGGCGGCGGCGCGCCCCGGGCTGTGAATGCGACTCGCCCCTCGGC
CGCGCTCCCCGCCCGCCCGCCCGCCGGGACGTGGTAGGGGATGCCCAGCTCCACTGCGAT
GGCAGTTGGCGCGCTCTCCAGTTCCCTCCTGGTCACCTGCTGCCTGATGGTGGCTCTGTG
CAGTCCGAGCATCCCGCTGGAGAAGCTGGCCCAGGCACCAGAGCAGCCGGGCCAGGAGAA
GCGTGAGCACGCCACTCGGGACGGCCCGGGCGGGTGAACGAGCTCGGGCGCCCGGCGAG
GGACGAGGGCGGCAGCGGCCGGGACTGGAAGAGCAAGAGCGGCCGTGGGCTCGCCGGCCG
TGAGCCGTGGAGCAAGCTGAAGCAGGCCTGGGTCTCCCAGGGCGGGGGCGCCAAGGCCGG
GGATCTGCAGGTCCGGCCCCGCGGGGACACCCCGCAGGCGGAAGCCCTGGCCGCAGCCGC
CCAGGACGCGATTGGCCCGGAACTCGCGCCCACGCCCGAGCCACCCGAGGAGTACGTGTA
CCCGGACTACCGTGGCAAGGGCTGCGTGGACGAGAGCGGCTTCGTGTACGCGATCGGGGA
GAAGTTCGCGCCGGGCCCCTCGGCCTGCCCGTGCCTGTGCACCGAGGAGGGGCCGCTGTG
CGCGCAGCCCGAGTGCCCGAGGCTGCACCCGCGCTGCATCCACGTCGACACGAGCCAGTG
CTGCCCGCAGTGCAAGGAGAGGAAGAACTACTGCGAGTTCCGGGGCAAGACCTATCAGAC
TTTGGAGGAGTTCGTGGTGTCTCCATGCGAGAGGTGTCGCTGTGAAGCCAACGGTGAGGT
GCTATGCACAGTGTCAGCGTGTCCCCAGACGGAGTGTGTGGACCCTGTGTACGAGCCTGA
TCAGTGCTGTCCCATCTGCAAAAATGGTCCAAACTGCTTTGCAGAAACCGCGGTGATCCC
TGCTGGCAGAGAAGTGAAGACTGACGAGTGCACCATATGCCACTGTACTTATGAGGAAGG
CACATGGAGAATCGAGCGGCAGGCCATGTGCACGAGACATGAATGCAGGCAAATGTAGAC
GCTTCCCAGAACACAAACTCTGACTTTTTCTAGAACATTTTACTGATGTGAACATTCTAG
ATGACTCTGGGAACTATCAGTCAAAGAAGACTTTTGATGAGGAATAATGGAAAATTGTTG
GTACTTTTCCTTTTCTTGATAACAGTTACTACAACAGAAGGAAATGGATATATTTCAAAA
CATCAACAAGAACTTTGGGCATAAAATCCTTCTCTAAATAAATGTGCTATTTTCACAGTA
AGTACACAAAAGTACACTATTATATATCAAATGTATTTCTATAATCCCTCCATTAGAGAG
CTTATATAAGTGTTTTCTATAGATGCAGATTAAAAATGCTGTGTTGTCAACCGTCAAAAA
AAAAAAAAAAAAAAAAAAAAAA
```

FIGURE 230

MPSSTAMAVGALSSSLLVTCCLMVALCSPSIPLEKLAQAPEQPGQEKREHATRDGPGRVN
ELGRPARDEGGSGRDWKSKSGRGLAGREPWSKLKQAWVSQGGGAKAGDLQVRPRGDTPQA
EALAAAAQDAIGPELAPTPEPPEEYVYPDYRGKGCVDESGFVYAIGEKFAPGPSACPCLC
TEEGPLCAQPECPRLHPRCIHVDTSQCCPQCKERKNYCEFRGKTYQTLEEFVVSPCERCR
CEANGEVLCTVSACPQTECVDPVYEPDQCCPICKNGPNCFAETAVIPAGREVKTDECTIC
HCTYEEGTWRIERQAMCTRHECRQM

Important features of the protein:
Signal peptide:
amino acids 1-27

Transmembrane domain:
amino acids 11-30

Glycosaminoglycan attachment site:
amino acids 80-83

N-myristoylation sites:
amino acids 10-15, 102-107, 103-108

Cell attachment sequence:
amino acids 114-117

EGF-like domain cysteine pattern signature:
amino acids 176-187

FIGURE 231

```
GGCCGGACGCCTCCGCGTTACGGGATGAATTAACGGCGGGTTCCGCACGGAGGTTGTGAC
CCCTACGGAGCCCCAGCTTGCCCACGCACCCCACTCGGCGTCGCGCGGCGTGCCCTGCTT
GTCACAGGTGGGAGGCTGGAACTATCAGGCTGAAAAACAGAGTGGGTACTCTCTTCTGGG
AAGCTGGCAACAAATGGATGATGTGATATATGCATTCCAGGGGAAGGGAAATTGTGGTGC
TTCTGAACCCATGGTCAATTAACGAGGCAGTTTCTAGCTACTGCACGTACTTCATAAAGC
AGGACTCTAAAAGCTTTGGAATCATGGTGTCATGGAAAGGGATTTACTTTATACTGACTC
TGTTTTGGGGAAGCTTTTTTGGAAGCATTTTCATGCTGAGTCCCTTTTTACCTTTGATGT
TTGTAAACCCATCTTGGTATCGCTGGATCAACAACCGCCTTGTGGCAACATGGCTCACCC
TACCTGTGGCATTATTGGAGACCATGTTTGGTGTAAAAGTGATTATAACTGGGGATGCAT
TTGTTCCTGGAGAAAGAAGTGTCATTATCATGAACCATCGGACAAGAATGGACTGGATGT
TCCTGTGGAATTGCCTGATGCGATATAGCTACCTCAGATTGGAGAAAATTTGCCTCAAAG
CGAGTCTCAAAGGTGTTCCTGGATTTGGTTGGGCCATGCAGGCTGCTGCCTATATCTTCA
TTCATAGGAAATGGAAGGATGACAAGAGCCATTTCGAAGACATGATTGATTACTTTTGTG
ATATTCACGAACCACTTCAACTCCTCATATTCCCAGAAGGGACTGATCTCACAGAAAACA
GCAAGTCTCGAAGTAATGCATTTGCTGAAAAAATGGACTTCAGAAATATGAATATGTTT
TACATCCAAGAACTACAGGCTTTACTTTTGTGGTAGACCGTCTAAGAGAAGGTAAGAACC
TTGATGCTGTCCATGATATCACTGTGGCGTATCCTCACAACATTCCTCAATCAGAGAAGC
ACCTCCTCCAAGGAGACTTTCCCAGGGAAATCCACTTTCACGTCCACCGGTATCCAATAG
ACACCCTCCCCACATCCAAGGAGGACCTTCAACTCTGGTGCCACAAACGGTGGGAAGAGA
AAGAAGAGAGGCTGCGTTCCTTCTATCAAGGGGAGAAGAATTTTATTTTACCGGACAGA
GTGTCATTCCACCTTGCAAGTCTGAACTCAGGGTCCTTGTGGTCAAATTGCTCTCTATAC
TGTATTGGACCCTGTTCAGCCCTGCAATGTGCCTACTCATATATTTGTACAGTCTTGTTA
AGTGGTATTTTATAATCACCATTGTAATCTTTGTGCTGCAAGAGAGAATATTTGGTGGAC
TGGAGATCATAGAACTTGCATGTTACCGACTTTTACACAAACAGCCACATTTAAATTCAA
AGAAAAATGAGTAAGATTATAAGGTTTGCCATGTGAAAACCTAGAGCATATTTTGGAAAT
GTTCTAAACCTTTCTAAGCTCAGATGCATTTTGCATGACTATGTCGAATATTTCTTACT
GCCATCATTATTTGTTAAAGATATTTTGCACTTAATTTTGTGGGAAAAATATTGCTACAA
TTTTTTTTAATCTCTGAATGTAATTTCGATACTGTGTACATAGCAGGGAGTGATCGGGGT
GAAATAACTTGGGCCAGAATATTATTAAACAATCATCAGGCTTTTAAA
```

FIGURE 232

MHSRGREIVVLLNPWSINEAVSSYCTYFIKQDSKSFGIMVSWKGIYFILTLFWGSFFGSI
FMLSPFLPLMFVNPSWYRWINNRLVATWLTLPVALLETMFGVKVIITGDAFVPGERSVII
MNHRTRMDWMFLWNCLMRYSYLRLEKICLKASLKGVPGFGWAMQAAAYIFIHRKWKDDKS
HFEDMIDYFCDIHEPLQLLIFPEGTDLTENSKSRSNAFAEKNGLQKYEYVLHPRTTGFTF
VVDRLREGKNLDAVHDITVAYPHNIPQSEKHLLQGDFPREIHFHVHRYPIDTLPTSKEDL
QLWCHKRWEEKEERLRSFYQGEKNFYFTGQSVIPPCKSELRVLVVKLLSILYWTLFSPAM
CLLIYLYSLVKWYFIITIVIFVLQERIFGGLEIIELACYRLLHKQPHLNSKKNE

Important features of the protein:
Signal peptide:
amino acids 1-22

Transmembrane domains:
amino acids 44-63, 90-108, 354-377

FIGURE 233

```
CGGCTCGAGTGCAGCTGTGGGGAGATTTCAGTGCATTGCCTCCCCTGGGTGCTCTTCATC
TTGGATTTGAAAGTTGAGAGCAGCATGTTTTGCCCACTGAAACTCATCCTGCTGCCAGTG
TTACTGGATTATTCCTTGGGCCTGAATGACTTGAATGTTTCCCCGCCTGAGCTAACAGTC
CATGTGGGTGATTCAGCTCTGATGGGATGTGTTTTCCAGAGCACAGAAGACAAATGTATA
TTCAAGATAGACTGGACTCTGTCACCAGGAGAGCACGCCAAGGACGAATATGTGCTATAC
TATTACTCCAATCTCAGTGTGCCTATTGGGCGCTTCCAGAACCGCGTACACTTGATGGGG
GACATCTTATGCAATGATGGCTCTCTCCTGCTCCAAGATGTGCAAGAGGCTGACCAGGGA
ACCTATATCTGTGAAATCCGCCTCAAAGGGGAGAGCCAGGTGTTCAAGAAGGCGGTGGTA
CTGCATGTGCTTCCAGAGGAGCCCAAAGAGCTCATGGTCCATGTGGGTGGATTGATTCAG
ATGGGATGTGTTTTCCAGAGCACAGAAGTGAAACACGTGACCAAGGTAGAATGGATATTT
TCAGGACGGCGCGCAAAGGAGGAGATTGTATTTCGTTACTACCACAAACTCAGGATGTCT
GTGGAGTACTCCCAGAGCTGGGGCCACTTCCAGAATCGTGTGAACCTGGTGGGGGACATT
TTCCGCAATGACGGTTCCATCATGCTTCAAGGAGTGAGGGAGTCAGATGGAGGAAACTAC
ACCTGCAGTATCCACCTAGGGAACCTGGTGTTCAAGAAACCATTGTGCTGCATGTCAGC
CCGGAAGAGCCTCGAACACTGGTGACCCCGGCAGCCCTGAGGCCTCTGGTCTTGGGTGGT
AATCAGTTGGTGATCATTGTGGGAATTGTCTGTGCCACAATCCTGCTGCTCCCTGTTCTG
ATATTGATCGTGAAGAAGACCTGTGGAAATAAGAGTTCAGTGAATTCTACAGTCTTGGTG
AAGAACACGAAGAAGACTAATCCAGAGATAAAAGAAAAACCCTGCCATTTTGAAAGATGT
GAAGGGGAGAAACACATTTACTCCCCAATAATTGTACGGGAGGTGATCGAGGAAGAAGAA
CCAAGTGAAAAATCAGAGGCCACCTACATGACCATGCACCCAGTTTGGCCTTCTCTGAGG
TCAGATCGGAACAACTCACTTGAAAAAAGTCAGGTGGGGAATGCCAAAAACACAGCAA
GCCTTTTGAGAAGAATGGAGAGTCCCTTCATCTCAGCAGCGGTGGAGACTCTCTCCTGTG
TGTGTCCTGGGCCACTCTACCAGTGATTTCAGACTCCCGCTCTCCCAGCTGTCCTCCTGT
CTCATTGTTTGGTCAATACACTGAAGATGGAGAATTTGGAGCCTGGCAGAGAGACTGGAC
AGCTCTGGAGGAACAGGCCTGCTGAGGGGAGGGGAGCATGGACTTGGCCTCTGGAGTGGG
ACACTGGCCCTGGGAACCAGGCTGAGCTGAGTGGCCTCAAACCCCCGTTGGATCAGACC
CTCCTGTGGGCAGGGTTCTTAGTGGATGAGTTACTGGGAAGAATCAGAGATAAAACCAA
CCCAAATCAA
```

FIGURE 234

MFCPLKLILLPVLLDYSLGLNDLNVSPPELTVHVGDSALMGCVFQSTEDKCIFKIDWTLS
PGEHAKDEYVLYYYSNLSVPIGRFQNRVHLMGDILCNDGSLLLQDVQEADQGTYICEIRL
KGESQVFKKAVVLHVLPEEPKELMVHVGGLIQMGCVFQSTEVKHVTKVEWIFSGRRAKEE
IVFRYYHKLRMSVEYSQSWGHFQNRVNLVGDIFRNDGSIMLQGVRESDGGNYTCSIHLGN
LVFKKTIVLHVSPEEPRTLVTPAALRPLVLGGNQLVIIVGIVCATILLLPVLILIVKKTC
GNKSSVNSTVLVKNTKKTNPEIKEKPCHFERCEGEKHIYSPIIVREVIEEEEPSEKSEAT
YMTMHPVWPSLRSDRNNSLEKKSGGGMPKTQQAF

FIGURE 235

TAAAACAGCTACAATATTCCAGGGCCAGTCACTTGCCATTTCTCATAACAGCGTCAGAGA
GAAAGAACTGACTGAAACGTTTGAG<u>ATG</u>AAGAAAGTTCTCCTCCTGATCACAGCCATCTT
GGCAGTGGCTGTTGGTTTCCCAGTCTCTCAAGACCAGGAACGAGAAAAAAGAAGTATCAG
TGACAGCGATGAATTAGCTTCAGGGTTTTTTGTGTTCCCTTACCCATATCCATTTCGCCC
ACTTCCACCAATTCCATTTCCAAGATTTCCATGGTTTAGACGTAATTTTCCTATTCCAAT
ACCTGAATCTGCCCCTACAACTCCCCTTCCTAGCGAAAAG<u>TAA</u>CAAGAAGGATAAGTCA
CGATAAACCTGGTCACCTGAAATTGAAATTGAGCCACTTCCTTGAAGAATCAAAATTCCT
GTTAATAAAGAAAACAAATGTAATTGAAATAGCACACAGCATTCTAGTCAATATCT
TTAGTGATCTTCTTTAATAAACATGAAAGCAAGATTTTGGTTTCTTAATTTCCACA

FIGURE 236

MKKVLLLITAILAVAVGFPVSQDQEREKRSISDSDELASGFFVFPYPYPFRPLPPIPFPR
FPWFRRNFPIPIPESAPTTPLPSEK

Important features of the protein:
Signal peptide:
amino acids 1-17

Homologous region to B3-hordein:
amino acids 47-85

FIGURE 237

```
TCGCCATGGCCTCTGCCGGAATGCAGATCCTGGGAGTCGTCCTGACACTGCTGGGCTGGG
TGAATGGCCTGGTCTCCTGTGCCCTGCCCATGTGGAAGGTGACCGCTTTCATCGGCAACA
GCATCGTGGTGGCCCAGGTGGTGTGGGAGGGCCTGTGGATGTCCTGCGTGGTGCAGAGCA
CCGGCCAGATGCAGTGCAAGGTGTACGACTCACTGCTGGCGCTGCCACAGGACCTGCAGG
CTGCACGTGCCCTCTGTGTCATCGCCCTCCTTGTGGCCCTGTTCGGCTTGCTGGTCTACC
TTGCTGGGGCCAAGTGTACCACCTGTGTGGAGGAGAAGGATTCCAAGGCCCGCCTGGTGC
TCACCTCTGGGATTGTCTTTGTCATCTCAGGGGTCCTGACGCTAATCCCCGTGTGCTGGA
CGGCGCATGCCATCATCCGGGACTTCTATAACCCCCTGGTGGCTGAGGCCCAAAAGCGGG
AGCTGGGGGCCTCCCTCTACTTGGGCTGGGCGGCCTCAGGCCTTTTGTTGCTGGGTGGGG
GGTTGCTGTGCTGCACTTGCCCCTCGGGGGGGTCCCAGGGCCCCAGCCATTACATGGCCC
GCTACTCAACATCTGCCCCTGCCATCTCTCGGGGGCCCTCTGAGTACCCTACCAAGAATT
ACGTCTGACGTGGAGGGGAATGGGGGCTCCGCTGGCGCTAGAGCCATCCAGAAGTGGCAG
TGCCCAACAGCTTTGGGATGGGTTCGTACCTTTTGTTTCTGCCTCCTGCTATTTTTCTTT
TGACTGAGGATATTTAAAATTCATTTGAAAACTGAGCCAAGGTGTTGACTCAGACTCTCA
CTTAGGCTCTGCTGTTTCTCACCCTTGGATGATGGAGCCAAAGAGGGGATGCTTTGAGAT
TCTGGATCTTGACATGCCCATCTTAGAAGCCAGTCAAGCTATGGAACTAATGCGGAGGCT
GCTTGCTGTGCTGGCTTTGCAACAAGACAGACTGTCCCCAAGAGTTCCTGCTGCTGCTGG
GGGCTGGGCTTCCCTAGATGTCACTGGACAGCTGCCCCCCATCCTACTCAGGTCTCTGGA
GCTCCTCTCTTCACCCCTGGAAAAACAAATCATCTGTTAACAAAGGACTGCCCACCTCCG
GAACTTCTGACCTCTGTTTCCTCCGTCCTGATAAGACGTCCACCCCCAGGGCCAGGTCC
CAGCTATGTAGACCCCCGCCCCCACCTCCAACACTGCACCCTTCTGCCCTGCCCCCCTCG
TCTCACCCCCTTTACACTCACATTTTTATCAAATAAAGCATGTTTTGTTAGTGCA
```

FIGURE 238

MASAGMQILGVVLTLLGWVNGLVSCALPMWKVTAFIGNSIVVAQVVWEGLWMSCVVQSTG
QMQCKVYDSLLALPQDLQAARALCVIALLVALFGLLVYLAGAKCTTCVEEKDSKARLVLT
SGIVFVISGVLTLIPVCWTAHAIIRDFYNPLVAEAQKRELGASLYLGWAASGLLLLGGGL
LCCTCPSGGSQGPSHYMARYSTSAPAISRGPSEYPTKNYV

Transmembrane domains:
amino acids 8-30 (type II), 82-102, 121-140, 166-186

FIGURE 239

AGTGACAATCTCAGAGCAGCTTCTACACCACAGCCATTTCCAGCATGAAGATCACTGGGG
GTCTCCTTCTGCTCTGTACAGTGGTCTATTTCTGTAGCAGCTCAGAAGCTGCTAGTCTGT
CTCCAAAAAAGTGGACTGCAGCATTTACAAGAAGTATCCAGTGGTGGCCATCCCCTGCC
CCATCACATACCTACCAGTTTGTGGTTCTGACTACATCACCTATGGGAATGAATGTCACT
TGTGTACCGAGAGCTTGAAAAGTAATGGAAGAGTTCAGTTTCTTCACGATGGAAGTTGCT
AAATTCTCCATGGACATAGAGAGAAAGGAATGATATTCTCATCATCATCTTCATCATCCC
AGGCTCTGACTGAGTTTCTTTCAGTTTTACTGATGTTCTGGGTGGGGACAGAGCCAGAT
TCAGAGTAATCTTGACTGAATGGAGAAAGTTTCTGTGCTACCCCTACAAACCCATGCCTC
ACTGACAGACCAGCATTTTTTTTTTAACACGTCAATAAAAAAATAATCTCCCAGA

FIGURE 240

MKITGGLLLLCTVVYFCSSSEAASLSPKKVDCSIYKKYPVVAIPCPITYLPVCGSDYITY
GNECHLCTESLKSNGRVQFLHDGSC

Signal peptide:
amino acids 1-19

FIGURE 241

CCCGCGCCCGGTTCTCCCTCGCAGCACCTCGAAGTGCGCCCCTCGCCCTCCTGCTCGCGC
CCCGCCGCCATGGCTGCCTCCCCGCGCGGCCTGCTGTCCTGGCCCTGACCGGGCTGGCG
CTGCTCCTGCTCCTGTGCTGGGGCCCAGGTGGCATAAGTGGAAATAAACTCAAGCTGATG
CTTCAAAAACGAGAAGCACCTGTTCCAACTAAGACTAAAGTGGCCGTTGATGAGAATAAA
GCCAAAGAATTCCTTGGCAGCCTGAAGCGCCAGAAGCGGCAGCTGTGGGACCGGACTCGG
CCCGAGGTGCAGCAGTGGTACCAGCAGTTTCTCTACATGGGCTTTGATGAAGCGAAATTT
GAAGATGACATCACCTATTGGCTTAACAGAGATCGAAATGGACATGAATACTATGGCGAT
TACTACCAACGTCACTATGATGAAGACTCTGCAATTGGTCCCCGGAGCCCCTACGGCTTT
AGGCATGGAGCCAGCGTCAACTACGATGACTACTAACCATGACTTGCCACACGCTGTACA
AGAAGCAAATAGCGATTCTCTTCATGTATCTCCTAATGCCTTACACTACTTGGTTTCTGA
TTTGCTCTATTTCAGCAGATCTTTTCTACCTACTTTGTGTGATCAAAAAAGAAGAGTTAA
AACAACACATGTAAATGCCTTTTGATATTTCATGGGAATGCCTCTCATTTAAAAATAGAA
ATAAAGCATTTTGTTAAAAAGA

FIGURE 242

MAASPARPAVLALTGLALLLLLCWGPGGISGNKLKLMLQKREAPVPTKTKVAVDENKAKE
FLGSLKRQKRQLWDRTRPEVQQWYQQFLYMGFDEAKFEDDITYWLNRDRNGHEYYGDYYQ
RHYDEDSAIGPRSPYGFRHGASVNYDDY

Signal peptide:
amino acids 1-30

FIGURE 243

```
CTCCATTAAACCACCACCAGCTCCCCAAGCCACCCCTTCAGCCATGAAGTTCCTGCTCCT
GGTCTTGGCAGCCCTCGGATTCCTGACCCAGGTGATCCCAGCCAGTGCAGGTGGGTCAAA
ATGTGTGAGTAACACCCCAGGATACTGCAGGACATGTTGCCACTGGGGGGAGACAGCATT
GTTCATGTGCAACGCTTCCAGAAAATGCTGCATCAGCTACTCCTTCCTGCCGAAGCCTGA
CCTACCACAGCTCATCGGTAACCACTGGCAATCAAGGAGAAGAAACACACAAAGGAAAGA
CAAGAAGCAACAAACGACCGTAACATCATAATAACCACTGCTATCGCCTCCACCAACTCA
GAGAAATATCATTTCCACAGTTCCAATTCCTCCTACATTGCTGAGTACTAGCCAAGGCTC
CTCTTTATGGGGCAGATATCTATAGCCAACCCCAAAACTTCTGTCTTCTATCATTCTGTC
ATTCATCTAGTAACTAATTTGGAGTTTGTATCTATCTTACGAGAACAATCATCATGCAGA
TTCGTCCACAGGGGATCTGTCAGTTTGGGTCCTCCAAATGAAAAATGTCAAGACAGAATT
GGACATGCAAAAGATTGACTGGGAGAACACACCTCTGATGGACAAAGGTGAGACAGAGCA
GCCACAGGCAGGGAGAGCCTTCAGACTGCAACGCTGGCCTGATACGTGTCAAAGGAGAGA
GGGATAGAGGAGGATTGAATAGAAGGAGACTAAGACTGCAGCTCTAAGAAAGTCTCAGCC
AAACAGATGGGGAGGCCCAAAGCAAGGCTTGCCCCTCAGAGGAGCTCACGCAGGGCAGGA
ATAGCCAGGTTCTCATATCCCAGGGGTTCAGACTTGGCTGAGAACAGCCCCTGGAGAACA
TGGGGTGACTGCTACCATAGGTCTGGAAGTATGAGGCTGTCCACCAACTATCCCCTTGAA
GCAAGTTCTCTTGAAAGGAAATCTAAACAGTGCACCCCATGGCTGCCACGGAGTATAAG
GAGGGAGAGAAAGGAGCTGAAAGTCTAGGTTTGGCCAGCTAGGTAGACTGACTTGTGAGG
TATTTATTTATTCATTTGAGTAACAAAGCAGACAGAATACATAGCCACCATTGGTAGTAC
ACCCCAAAAGCAAGGATGGCATGATGCTGGTGACTCAAACGTGCCTACTCATGGTGTCAA
ATTGGCATAATCCTCTTGGGAAGCTGTGTGGAAATAAGCACAGAGAAGCAGAACTCTAAT
TGCTTAATCCACTAAACATTACTTCTGGGAATTGGCTCATCATAAATTATCCAAGAGAAA
GCACAAAGTTATGGGCACAAAGGTTTTCCATATAATATTATTTAAAATGCTGAGAAAATG
AAAAAATCTAAATGGTGAAATATATACTAATGCCATCTATAAATACAAACAAATAGAATG
TTTATAGAATAATGGAACATAATAACATTATTCAAAATTGCATTTATGCTATAGTTGTCA
AAATTGTCTCCTTATATGATACAAAACTCATGAAAATTATGACTTTTTTGTTTGGTTGGA
AAGCAGAATTATGCATAAATTTCCTCTTACAGTTCGATGCCCATTAGTTTTATATAACAT
TTATTTGACACGTACTGACTTCTATCTGAGAAGAACAAACCAAAACACTCAGGCCTAAAT
AATTAAAAACGGTCCTAAAAACTAGCAAACCAGATAAGAAAGATGTTAATGCCCATTCC
CTAACTTATGTCTTAGACCAAAATTAATTCTAGATGGTTTTAAAATGACAGTGTAAAAGT
AAAGTATTAAAAGATTGTGTGGTCAAATATTCAATTTAAGAGCAAGGAAATTCTTATAAA
TATAACAATAGAGGCAGAACTCATGTAAGAATAAATTGATTAGGTGGTATTAAATATTAA
GTTCTTATGTATGTCAAAAGATATCATTTTGAAATTCATCCATCTTATTGGGTATTGCAG
GAGTTCATTCCTTTTTGTTTATAAATACTCTTCCGTCATATGAATAGTATTCATTTGTAT
ACTGGTTTGTTGATGGACATTTGGGTTGTTCCCAGTTTATGGCTATTACAAATAAAGCTT
CTATGAACATTTATGTACA
```

FIGURE 244

MKFLLLVLAALGFLTQVIPASAGGSKCVSNTPGYCRTCCHWGETALFMCNASRKCCISYS
FLPKPDLPQLIGNHWQSRRRNTQRKDKKQQTTVTS

Important features of the protein:
Signal peptide:
amino acids 1-16

Transmembrane domain:
amino acids 1-22

N-glycosylation site:
amino acids 50-53 cAMP- and cGMP-dependent protein kinase phosphorylation site:
amino acids 79-82

N-myristoylation site:
amino acids 23-28

FIGURE 245

GGAGAGAGGCGCGCGGGTGAAAGGCGCATTGATGCAGCCTGCGGCGGCCTCGGAGCGCGG
CGGAGCCAGACGCTGACCACGTTCCTCTCCTCGGTCTCCTCCGCCTCCAGCTCCGCGCTG
CCCGGCAGCCGGGAGCCATGCGACCCCAGGGCCCCGCCGCCTCCCCGCAGCGGCTCCGCG
GCCTCCTGCTGCTCCTGCTGCTGCAGCTGCCCGCGCCGTCGAGCGCCTCTGAGATCCCCA
AGGGGAAGCAAAAGGCGCAGCTCCGGCAGAGGGAGGTGGTGGACCTGTATAATGGAATGT
GCTTACAAGGGCCAGCAGGAGTGCCTGGTCGAGACGGGAGCCCTGGGGCCAATGTTATTC
CGGGTACACCTGGGATCCCAGGTCGGGATGGATTCAAAGGAGAAAAGGGGGAATGTCTGA
GGGAAAGCTTTGAGGAGTCCTGGACACCCAACTACAAGCAGTGTTCATGGAGTTCATTGA
ATTATGGCATAGATCTTGGGAAAATTGCGGAGTGTACATTTACAAAGATGCGTTCAAATA
GTGCTCTAAGAGTTTTGTTCAGTGGCTCACTTCGGCTAAAATGCAGAAATGCATGCTGTC
AGCGTTGGTATTTCACATTCAATGGAGCTGAATGTTCAGGACCTCTTCCCATTGAAGCTA
TAATTTATTTGGACCAAGGAAGCCCTGAAATGAATTCAACAATTAATATTCATCGCACTT
CTTCTGTGGAAGGACTTTGTGAAGGAATTGGTGCTGGATTAGTGGATGTTGCTATCTGGG
TTGGCACTTGTTCAGATTACCCAAAAGGAGATGCTTCTACTGGATGGAATTCAGTTTCTC
GCATCATTATTGAAGAACTACCAAAATAAATGCTTTAATTTTCATTTGCTACCTCTTTTT
TTATTATGCCTTGGAATGGTTCACTTAAATGACATTTTAAATAAGTTTATGTATACATCT
GAATGAAAAGCAAAGCTAAATATGTTTACAGACCAAAGTGTGATTTCACACTGTTTTTAA
ATCTAGCATTATTCATTTTGCTTCAATCAAAAGTGGTTTCAATATTTTTTTAGTTGGTT
AGAATACTTTCTTCATAGTCACATTCTCTCAACCTATAATTTGGAATATTGTTGTGGTCT
TTTGTTTTTTCTCTTAGTATAGCATTTTTAAAAAAATATAAAAGCTACCAATCTTTGTAC
AATTTGTAAATGTTAAGAATTTTTTTTATATCTGTTAAATAAAAATTATTTCCAACA

FIGURE 246

MRPQGPAASPQRLRGLLLLLLLQLPAPSSASEIPKGKQKAQLRQREVVDLYNGMCLQGPA
GVPGRDGSPGANVIPGTPGIPGRDGFKGEKGECLRESFEESWTPNYKQCSWSSLNYGIDL
GKIAECTFTKMRSNSALRVLFSGSLRLKCRNACCQRWYFTFNGAECSGPLPIEAIIYLDQ
GSPEMNSTINIHRTSSVEGLCEGIGAGLVDVAIWVGTCSDYPKGDASTGWNSVSRIIIEE
LPK

Signal peptide:
amino acids 1-30

Transmembrane domain:
amino acids 195-217

FIGURE 247

```
GGCCGTTGGTTGGTGCGCGGCTGAAGGGTGTGGCGCGAGCAGCGTCGTTGGTTGGCCGGC
GGCGGGCCGGGACGGGCATGGCCCTGCTGCTGTGCCTGGTGTGCCTGACGGCGGCGCTGG
CCCACGGCTGTCTGCACTGCCACAGCAACTTCTCCAAGAAGTTCTCCTTCTACCGCCACC
ATGTGAACTTCAAGTCCTGGTGGGTGGGCGACATCCCCGTGTCAGGGGCGCTGCTCACCG
ACTGGAGCGACGACACGATGAAGGAGCTGCACCTGGCCATCCCCGCCAAGATCACCCGGG
AGAAGCTGGACCAAGTGGCGACAGCAGTGTACCAGATGATGGATCAGCTGTACCAGGGGA
AGATGTACTTCCCCGGGTATTTCCCCAACGAGCTGCGAAACATCTTCCGGGAGCAGGTGC
ACCTCATCCAGAACGCCATCATCGAAAGGCACCTGGCACCAGGCAGCTGGGGAGGAGGGC
AGCTCTCCAGGGAGGGACCCAGCCTAGCACCTGAAGGATCAATGCCATCACCCCGCGGGG
ACCTCCCCTAAGTAGCCCCCAGAGGCGCTGGGAGTGTTGCCACCGCCCTCCCCTGAAGTT
TGCTCCATCTCACGCTGGGGGTCAACCTGGGGACCCCTTCCCTCCGGGCCATGGACACAC
ATACATGAAAACCAGGCCGCATCGACTGTCAGCACCGCTGTGGCATCTTCCAGTACGAGA
CCATCTCCTGCAACAACTGCACAGACTCGCACGTCGCCTGCTTTGGCTATAACTGCGAGT
AGGGCTCAGGCATCACACCCACCCGTGCCAGGGCCCTACTGTCCCTGGGGTCCCAGGCTC
TCCTTGGAGGGGGCTCCCCGCCTTCCACCTGGCTGTCATCGGGTAGGGCGGGGCCGTGGG
TTCAGGGGCGCACCACTTCCAAGCCTGTGTCCCACAGGTCCTCGGCGCAGTGGAAGTCAG
CTGTCCAGGGCCTCCTGAACTACATAAATAACTGGCACAAGTAAGTCCCCTCCTCAAACC
AACACAGGCAGTGTGTGTATGTGAGCACCTCGTGGGTGAGTATGTGTGGGCACAGGCTG
GCTCCCTCAGCTCCCACGTCCTAGAGGGGCTCCCGAGGAGGTGGAACCTCAACCCAGCTC
TGCGCAGGAGGCGGCTGCAGTCCTTTTCTCCCTCAAAGGTCTCCGACCCTCAGCTGGAGG
CGGGCATCTTTCCTAAAGGGTCCCCATAGGGTCTGGTTCCACCCCATCCCAGGTCTGTGG
TCAGAGCCTGGGAGGGTTCCCTACGATGGTTAGGGGTGCCCCATGGAGGGGCTGACTGCC
CCACATTGCCTTTCAGACAGGACACGAGCATGAGGTAAGGCCGCCCTGACCTGGACTTCA
GGGGGAGGGGTAAAGGGAGAGAGGAGGGGGCTAGGGGTCCTCTAGATCAGTGGGGGC
ACTGCAGGTGGGGCTCTCCCTATACCTGGGACACCTGCTGGATGTCACCTCTGCAACCAC
ACCCATGTGGTGGTTTCATGAACAGACCACGCTCCTCTGCCTTCTCCTGGCCTGGGACAC
ACAGAGCCACCCCGGCCTTGTGAGTGACCCAGAGAAGGGAGGCCTCGGGAGAAGGGGTGC
TCGTAAGCCAACACCAGCGTGCCGCGGCCTGCACACCCTTCGGACATCCCAGGCACGAGG
GTGTCGTGGATGTGGCCACACATAGGACCACACGTCCCAGCTGGGAGGAGAGGCCTGGGG
CCCCCAGGGAGGGAGGCAGGGGGTGGGGGACATGGAGAGCTGAGGCAGCCTCGTCTCCCC
GCAGCCTGGTATCGCCAGCCTTAAGGTGTCTGGAGCCCCCACACTTGGCCAACCTGACCT
TGGAAGATGCTGCTGAGTGTCTCAAGCAGCACTGACAGCAGCTGGGCCTGCCCCAGGGCA
ACGTGGGGCGGAGACTCAGCTGGACAGCCCTGCCTGTCACTCTGGAGCTGGGCTGCTG
CTGCCTCAGGACCCCCTCTCCGACCCCGGACAGAGCTGAGCTGGCCAGGGCCAGGAGGGC
GGGAGGGAGGGAATGGGGGTGGGCTGTGCGCAGCATCAGCGCCTGGGCAGGTCCGCAGAG
CTGCGGGATGTGATTAAAGTCCCTGATGTTTCTC
```

FIGURE 248

MALLLCLVCLTAALAHGCLHCHSNFSKKFSFYRHHVNFKSWWVGDIPVSGALLTDWSDDT
MKELHLAIPAKITREKLDQVATAVYQMMDQLYQGKMYFPGYFPNELRNIFREQVHLIQNA
IIERHLAPGSWGGGQLSREGPSLAPEGSMPSPRGDLP

Signal peptide:
amino acids 1-15

FIGURE 249

```
CGACGATGCTACGCGCGCCCGGCTGCCTCCTCCGGACCTCCGTAGCGCCTGCCGCGGCCC
TGGCTGCGGCGCTGCTCTCGTCGCTTGCGCGCTGCTCTCTTCTAGAGCCGAGGGACCCGG
TGGCCTCGTCGCTCAGCCCCTATTTCGGCACCAAGACTCGCTACGAGGATGTCAACCCCG
TGCTATTGTCGGGCCCCGAGGCTCCGTGGCGGGACCCTGAGCTGCTGGAGGGGACCTGCA
CCCCGGTGCAGCTGGTCGCCCTCATTCGCCACGGCACCCGCTACCCCACGGTCAAACAGA
TCCGCAAGCTGAGGCAGCTGCACGGGTTGCTGCAGCCCGCGGGTCCAGGGATGGCGGGG
CTAGTAGTACCGGCAGCCGCGACCTGGGTGCAGCGCTGGCCGACTGGCCTTTGTGGTACG
CGGACTGGATGGACGGGCAGCTAGTAGAGAAGGGACGGCAGGATATGCGACAGCTGGCGC
TGCGTCTGGCCTCGCTCTTCCCGGCCCTTTTCAGCCGTGAGAACTACGGCCGCCTGCGGC
TCATCACCAGTTCCAAGCACCGCTGCATGGATAGCAGCGCCGCCTTCCTGCAGGGGCTGT
GGCAGCACTACCACCCTGGCTTGCCGCCGCCGGACGTCGCAGATATGGAGTTTGGACCTC
CAACAGTTAATGATAAACTAATGAGATTTTTTGATCACTGTGAGAAGTTTTTAACTGAAG
TAGAAAAAAATGCTACAGCTCTTTATCACGTGGAAGCCTTCAAAACTGGACCAGAAATGC
AGAACATTTTAAAAAAAGTTGCAGCTACTTTGCAAGTGCCAGTAAATGATTTAAATGCAG
ATTTAATTCAAGTAGCCTTTTTCACCTGTTCATTTGACCTGGCAATTAAAGGTGTTAAAT
CTCCTTGGTGTGATGTTTTTGACATAGATGATGCAAAGGTATTAGAATATTTAAATGATC
TGAAACAATATTGGAAAGAGGATATGGGTATACTATTAACAGTCGATCCAGCTGCACCT
TGTTTCAGGATATCTTTCAGCACTTGGACAAAGCAGTTGAACAGAAACAAAGGTCTCAGC
CAATTTCTTCTCCAGTCATCCTCCAGTTTGGTCATGCAGAGACTCTTCTTCCACTGCTTT
CTCTCATGGGCTACTTCAAAGACAAGGAACCCCTAACAGCGTACAATTACAAAAAACAAA
TGCATCGGAAGTTCCGAAGTGGTCTCATTGTACCTTATGCCTCGAACCTGATATTTGTGC
TTTACCACTGTGAAAATGCTAAGACTCCTAAAGAACAATTCGAGTGCAGATGTTATTAA
ATGAAAAGGTGTTACCTTTGGCTTACTCACAAGAAACTGTTTCATTTTATGAAGATCTGA
AGAACCACTACAAGGACATCCTTCAGAGTTGTCAAACCAGTGAAGAATGTGAATTAGCAA
GGGCTAACAGTACATCTGATGAACTATGAGTAACTGAAGAACATTTTTAATTCTTTAGGA
ATCTGCAATGAGTGATTACATGCTTGTAATAGGTAGGCAATTCCTTGATTACAGGAAGCT
TTTATATTACTTGAGTATTTCTGTCTTTTCACAGAAAACATTGGGTTTCTCTCTGGGTT
TGGACATGAAATGTAAGAAAGATTTTCACTGGAGCAGCTCTCTTAAGGAGAAACAAAT
CTATTTAGAGAAACAGCTGGCCCTGCAAATGTTTACAGAATGAAATTCTTCCTACTTAT
ATAAGAAATCTCACACTGAGATAGAATTGTGATTTCATAATAACACTTGAAAAGTGCTGG
AGTAACAAAATATCTCAGTTGGACCATCCTTAACTTGATTGAACTGTCTAGGAACTTTAC
AGATTGTTCTGCAGTTCTCTCTTCTTTTCCTCAGGTAGGACAGCTCTAGCATTTTCTTAA
TCAGGAATATTGTGGTAAGCTGGGAGTATCACTCTGGAAGAAAGTAACATCTCCAGATGA
GAATTTGAAACAAGAAACAGAGTGTTGTAAAAGGACACCTTCACTGAAGCAAGTCGGAAA
GTACAATGAAAATAAATATTTTGGTATTTATTTATGAAATATTTGAACATTTTTCAAT
AATTCCTTTTTACTTCTAGGAAGTCTCAAAAGACCATCTTAAATTATTATATGTTTGGAC
AATTAGCAACAAGTCAGATAGTTAGAATCGAAGTTTTTCAAATCCATTGCTTAGCTAACT
TTTTCATTCTGTCACTTGGCTTCGATTTTTATATTTTCCTATTATATGAAATGTATCTTT
TGGTTGTTTGATTTTCTTTCTTTCTTTGTAAATAGTTCTGAGTTCTGTCAAATGCCGTG
AAAGTATTTGCTATAATAAAGAAAATTCTTGTGACTTTAAAAAAAA
```

FIGURE 250

MLRAPGCLLRTSVAPAAALAAALLSSLARCSLLEPRDPVASSLSPYFGTKTRYEDVNPVL
LSGPEAPWRDPELLEGTCTPVQLVALIRHGTRYPTVKQIRKLRQLHGLLQARGSRDGGAS
STGSRDLGAALADWPLWYADWMDGQLVEKGRQDMRQLALRLASLFPALFSRENYGRLRLI
TSSKHRCMDSSAAFLQGLWQHYHPGLPPPDVADMEFGPPTVNDKLMRFFDHCEKFLTEVE
KNATALYHVEAFKTGPEMQNILKKVAATLQVPVNDLNADLIQVAFFTCSFDLAIKGVKSP
WCDVFDIDDAKVLEYLNDLKQYWKRGYGYTINSRSSCTLFQDIFQHLDKAVEQKQRSQPI
SSPVILQFGHAETLLPLLSLMGYFKDKEPLTAYNYKKQMHRKFRSGLIVPYASNLIFVLY
HCENAKTPKEQFRVQMLLNEKVLPLAYSQETVSFYEDLKNHYKDILQSCQTSEECELARA
NSTSDEL

Important features:
Signal sequence
amino acids 1-30

N-glycosylation sites:
amino acids 242-246, 481-485

N-myristoylation sites.
amino acids 107-113, 113-119, 117-123, 118-124, 128-134

Endoplasmic reticulum targeting sequence:
amino acids 484-489

FIGURE 251

```
GGAGAGCCGCGGCTGGGACCGGAGTGGGGAGCGCGGCGTGGAGGTGCCACCCGGCGCGGG
TGGCGGAGAGATCAGAAGCCTCTTCCCCAAGCCGAGCCAACCTCAGCGGGGACCCGGGCT
CAGGGACGCGGCGGCGGCGGCGGCGACTGCAGTGGCTGGACGATGGCAGCGTCCGCCGGA
GCCGGGGCGGTGATTGCAGCCCCAGACAGCCGGCGCTGGCTGTGGTCGGTGCTGGCGGCG
GCGCTTGGGCTCTTGACAGCTGGAGTATCAGCCTTGGAAGTATATACGCCAAAAGAAATC
TTCGTGGCAAATGGTACACAAGGGAAGCTGACCTGCAAGTTCAAGTCTACTAGTACGACT
GGCGGGTTGACCTCAGTCTCCTGGAGCTTCCAGCCAGAGGGGGCCGACACTACTGTGTCG
TTTTTCCACTACTCCCAAGGGCAAGTGTACCTTGGGAATTATCCACCATTTAAAGACAGA
ATCAGCTGGGCTGGAGACCTTGACAAGAAAGATGCATCAATCAACATAGAAAATATGCAG
TTTATACACAATGGCACCTATATCTGTGATGTCAAAAACCCTCCTGACATCGTTGTCCAG
CCTGGACACATTAGGCTCTATGTCGTAGAAAAGAGAATTTGCCTGTGTTTCCAGTTTGG
GTAGTGGTGGGCATAGTTACTGCTGTGGTCCTAGGTCTCACTCTGCTCATCAGCATGATT
CTGGCTGTCCTCTATAGAAGGAAAAACTCTAAACGGGATTACACTGGCTGCAGTACATCA
GAGAGTTTGTCACCAGTTAAGCAGGCTCCTCGGAAGTCCCCCTCCGACACTGAGGGTCTT
GTAAAGAGTCTGCCTTCTGGATCTCACCAGGGCCCAGTCATATATGCACAGTTAGACCAC
TCCGGCGGACATCACAGTGACAAGATTAACAAGTCAGAGTCTGTGGTGTATGCGGATATC
CGAAAGAATTAAGAGAATACCTAGAACATATCCTCAGCAAGAAACAAAACCAAACTGGAC
TCTCGTGCAGAAAATGTAGCCCATTACCACATGTAGCCTTGGAGACCCAGGCAAGGACAA
GTACACGTGTACTCACAGAGGGAGAGAAAGATGTGTACAAAGGATATGTATAAATATTCT
ATTTAGTCATCCTGATATGAGGAGCCAGTGTTGCATGATGAAAAGATGGTATGATTCTAC
ATATGTACCCATTGTCTTGCTGTTTTGTACTTTCTTTTCAGGTCATTTACAATTGGGAG
ATTTCAGAAACATTCCTTTCACCATCATTTAGAAATGGTTTGCCTTAATGGAGACAATAG
CAGATCCTGTAGTATTTCCAGTAGACATGGCCTTTTAATCTAAGGGCTTAAGACTGATTA
GTCTTAGCATTTACTGTAGTTGGAGGATGGAGATGCTATGATGGAAGCATACCCAGGGTG
GCCTTTAGCACAGTATCAGTACCATTTATTTGTCTGCCGCTTTTAAAAAATACCCATTGG
CTATGCCACTTGAAAACAATTTGAGAAGTTTTTTTGAAGTTTTTCTCACTAAAATATGGG
GCAATTGTTAGCCTTACATGTTGTGTAGACTTACTTTAAGTTTGCACCCTTGAAATGTGT
CATATCAATTTCTGGATTCATAATAGCAAGATTAGCAAAGGATAAATGCCGAAGGTCACT
TCATTCTGGACACAGTTGGATCAATACTGATTAAGTAGAAAATCCAAGCTTTGCTTGAGA
ACTTTTGTAACGTGGAGAGTAAAAAGTATCGGTTTTA
```

FIGURE 252

MAASAGAGAVIAAPDSRRWLWSVLAAALGLLTAGVSALEVYTPKEIFVANGTQGKLTCKF
KSTSTTGGLTSVSWSFQPEGADTTVSFFHYSQGQVYLGNYPPFKDRISWAGDLDKKDASI
NIENMQFIHNGTYICDVKNPPDIVVQPGHIRLYVVEKENLPVFPVWVVVGIVTAVVLGLT
LLISMILAVLYRRKNSKRDYTGCSTSESLSPVKQAPRKSPSDTEGLVKSLPSGSHQGPVI
YAQLDHSGGHHSDKINKSESVVYADIRKN

Signal peptide:
amino acids 1-37

Transmembrane domain:
amino acids 161-183

FIGURE 253

GTGACACTATAGAAGAGCTATGACGTCGCATGCACGCGTACGTAAGCTCGGAATTCGGCT
CGAGGCTGGTGGGAAGAAGCCGAGATGGCGGCAGCCAGCGCTGGGGCAACCCGGCTGCTC
CTGCTCTTGCTGATGGCGGTAGCAGCGCCCAGTCGAGCCCGGGGCAGCGGCTGCCGGGCC
GGGACTGGTGCGCGAGGGGCTGGGCGGAAGGTCGAGAGGGCGAGGCCTGTGGCACGGTG
GGGCTGCTGCTGGAGCACTCATTTGAGATCGATGACAGTGCCAACTTCCGGAAGCGGGGC
TCACTGCTCTGGAACCAGCAGGATGGTACCTTGTCCCTGTCACAGCGGCAGCTCAGCGAG
GAGGAGCGGGGCCGACTCCGGGATGTGGCAGCCCTGAATGGCCTGTACCGGGTCCGGATC
CCAAGGCGACCCGGGGCCCTGGATGGCCTGGAAGCTGGTGGCTATGTCTCCTCCTTTGTC
CCTGCGTGCTCCCTGGTGGAGTCGCACCTGTCGGACCAGCTGACCCTGCACGTGGATGTG
GCCGGCAACGTGGTGGGCGTGTCGGTGGTGACGCACCCCGGGGGCTGCCGGGGCCATGAG
GTGGAGGACGTGGACCTGGAGCTGTTCAACACCTCGGTGCAGCTGCAGCCGCCCACCACA
GCCCCAGGCCCTGAGACGGCGGCCTTCATTGAGCGCCTGGAGATGGAACAGGCCCAGAAG
GCCAAGAACCCCCAGGAGCAGAAGTCCTTCTTCGCCAAATACTGGATGTACATCATTCCC
GTCGTCCTGTTCCTCATGATGTCAGGAGCGCCAGACACCGGGGGCCAGGGTGGGGGTGGG
GGTGGGGGTGGTGGTGGGGGTAGTGGCCTTTGCTGTGTGCCACCCTCCCTGTAAGTCTAT
TTAAAAACATCGACGATACATTGAAATGTGTGAACGTTTTGAAAAGCTACAGCTTCCAGC
AGCCAAAAGCAACTGTTGTTTTGGCAAGACGGTCCTGATGTACAAGCTTGATTGAAATTC
ACTGCTCACTTGATACGTTATTCAGAAACCCAAGGAATGGCTGTCCCCATCCTCATGTGG
CTGTGTGGAGCTCAGCTGTGTTGTGTGGCAGTTTATTAAACTGTCCCCAGATCGACACG
CAAAAAAAAA

FIGURE 254

MAAASAGATRLLLLLLMAVAAPSRARGSGCRAGTGARGAGAEGREGEACGTVGLLLEHSF
EIDDSANFRKRGSLLWNQQDGTLSLSQRQLSEEERGRLRDVAALNGLYRVRIPRRPGALD
GLEAGGYVSSFVPACSLVESHLSDQLTLHVDVAGNVVGVSVVTHPGGCRGHEVEDVDLEL
FNTSVQLQPPTTAPGPETAAFIERLEMEQAQKAKNPQEQKSFFAKYWMYIIPVVLFLMMS
GAPDTGGQGGGGGGGGGGSGLCCVPPSL

Signal peptide:
amino acids 1-24

Transmembrane domain:
amino acids 226-243

FIGURE 255

GCGACGCGCGGCGGGGCGGCGAGAGGAAACGCGGCGCCGGGCCGGGCCCGGCCCTGGAGA
TGGTCCCCGGCGCCGCGGGCTGGTGTTGTCTCGTGCTCTGGCTCCCCGCGTGCGTCGCGG
CCCACGGCTTCCGTATCCATGATTATTTGTACTTTCAAGTGCTGAGTCCTGGGGACATTC
GATACATCTTCACAGCCACACCTGCCAAGGACTTTGGTGGTATCTTTCACACAAGGTATG
AGCAGATTCACCTTGTCCCCGCTGAACCTCCAGAGGCCTGCGGGGAACTCAGCAACGGTT
TCTTCATCCAGGACCAGATTGCTCTGGTGGAGAGGGGGGCTGCTCCTTCCTCTCCAAGA
CTCGGGTGGTCCAGGAGCACGGCGGGCGGCGGTGATCATCTCTGACAACGCAGTTGACA
ATGACAGCTTCTACGTGGAGATGATCCAGGACAGTACCCAGCGCACAGCTGACATCCCCG
CCCTCTTCCTGCTCGGCCGAGACGGCTACATGATCCGCCGCTCTCTGGAACAGCATGGGC
TGCCATGGGCCATCATTTCCATCCAGTCAATGTCACCAGCATCCCCACCTTTGAGCTGC
TGCAACCGCCCTGGACCTTCTGGTAGAAGAGTTTGTCCCACATTCCAGCCATAAGTGACT
CTGAGCTGGGAAGGGGAAACCCAGGAATTTTGCTACTTGGAATTTGGAGATAGCATCTGG
GGACAAGTGGAGCCAGGTAGAGGAAAAGGGTTTGGGCGTTGCTAGGCTGAAAGGGAAGCC
ACACCACTGGCCTTCCCTTCCCCAGGGCCCCCAAGGGTGTCTCATGCTACAAGAAGAGGC
AAGAGACAGGCCCCAGGGCTTCTGGCTAGAACCCGAAACAAAAGGAGCTGAAGGCAGGTG
GCCTGAGAGCCATCTGTGACCTGTCACACTCACCTGGCTCCAGCCTCCCCTACCCAGGGT
CTCTGCACAGTGACCTTCACAGCAGTTGTTGGAGTGGTTTAAAGAGCTGGTGTTTGGGGA
CTCAATAAACCCTCACTGACTTTTTAGCAATAAAGCTTCTCATCAGGGTTGCAAAAAAAA
AAAAAAAAAAAAAAAAAA

FIGURE 256

MVPGAAGWCCLVLWLPACVAAHGFRIHDYLYFQVLSPGDIRYIFTATPAKDFGGIFHTRY
EQIHLVPAEPPEACGELSNGFFIQDQIALVERGGCSFLSKTRVVQEHGGRAVIISDNAVD
NDSFYVEMIQDSTQRTADIPALFLLGRDGYMIRRSLEQHGLPWAIISIPVNVTSIPTFEL
LQPPWTFW

Signal peptide:
amino acids 1-20

FIGURE 257

CTCGCTTCTTCCTTCTGGATGGGGGCCCAGGGGGCCCAGGAGAGTATAAAGGCGATGTGG
AGGGTGCCCGGCACAACCAGACGCCCAGTCACAGGCGAGAGCCCTGGGATGCACCGGCCA
GAGGCCATGCTGCTGCTGCTCACGCTTGCCCTCCTGGGGGGCCCCACCTGGGCAGGGAAG
ATGTATGGCCCTGGAGGAGGCAAGTATTTCAGCACCACTGAAGACTACGACCATGAAATC
ACAGGGCTGCGGGTGTCTGTAGGTCTTCTCCTGGTGAAAAGTGTCCAGGTGAAACTTGGA
GACTCCTGGGACGTGAAACTGGGAGCCTTAGGTGGGAATACCCAGGAAGTCACCCTGCAG
CCAGGCGAATACATCACAAAAGTCTTTGTCGCCTTCCAAGCTTTCCTCCGGGGTATGGTC
ATGTACACCAGCAAGGACCGCTATTTCTATTTTGGGAAGCTTGATGGCCAGATCTCCTCT
GCCTACCCCAGCCAAGAGGGGCAGGTGCTGGTGGGCATCTATGGCCAGTATCAACTCCTT
GGCATCAAGAGCATTGGCTTTGAATGGAATTATCCACTAGAGGAGCCGACCACTGAGCCA
CCAGTTAATCTCACATACTCAGCAAACTCACCCGTGGGTCGCTAGGGTGGGGTATGGGGC
CATCCGAGCTGAGGCCATCTGTGTGGTGGTGGCTGATGGTACTGGAGTAACTGAGTCGGG
ACGCTGAATCTGAATCCACCAATAAATAAAGCTTCTGCAGAAAA

FIGURE 258

MHRPEAMLLLLTLALLGGPTWAGKMYGPGGGKYFSTTEDYDHEITGLRVSVGLLLVKSVQ
VKLGDSWDVKLGALGGNTQEVTLQPGEYITKVFVAFQAFLRGMVMYTSKDRYFYFGKLDG
QISSAYPSQEGQVLVGIYGQYQLLGIKSIGFEWNYPLEEPTTEPPVNLTYSANSPVGR

Signal peptide:
amino acids 1-22

FIGURE 259

CAGACATGGCTCAGTCACTGGCTCTGAGCCTCCTTATCCTGGTTCTGGCCTTTGGCATCC
CCAGGACCCAAGGCAGTGATGGAGGGGCTCAGGACTGTTGCCTCAAGTACAGCCAAAGGA
AGATTCCCGCCAAGGTTGTCCGCAGCTACCGGAAGCAGGAACCAAGCTTAGGCTGCTCCA
TCCCAGCTATCCTGTTCTTGCCCCGCAAGCGCTCTCAGGCAGAGCTATGTGCAGACCCAA
AGGAGCTCTGGGTGCAGCAGCTGATGCAGCATCTGGACAAGACACCATCCCCACAGAAAC
CAGCCCAGGGCTGCAGGAAGGACAGGGGGGCCTCCAAGACTGGCAAGAAAGGAAAGGGCT
CCAAAGGCTGCAAGAGGACTGAGCGGTCACAGACCCCTAAAGGGCCATAGCCCAGTGAGC
AGCCTGGAGCCCTGGAGACCCCACCAGCCTCACCAGCGCTTGAAGCCTGAACCCAAGATG
CAAGAAGGAGGCTATGCTCAGGGGCCCTGGAGCAGCCACCCCATGCTGGCCTTGCCACAC
TCTTTCTCCTGCTTTAACCACCCCATCTGCATTCCCAGCTCTACCCTGCATGGCTGAGCT
GCCCACAGCAGGCCAGGTCCAGAGAGACCGAGGAGGGAGAGTCTCCCAGGGAGCATGAGA
GGAGGCAGCAGGACTGTCCCCTTGAAGGAGAATCATCAGGACCCTGGACCTGATACGGCT
CCCCAGTACACCCCACCTCTTCCTTGTAAATATGATTTATACCTAACTGAATAAAAGCT
GTTCTGTCTTCCCNCCCA

FIGURE 260

MAQSLALSLLILVLAFGIPRTQGSDGGAQDCCLKYSQRKIPAKVVRSYRKQEPSLGCSIP
AILFLPRKRSQAELCADPKELWVQQLMQHLDKTPSPQKPAQGCRKDRGASKTGKKGKGSK
GCKRTERSQTPKGP

Important features of the protein:
Signal peptide:
amino acids 1-17 cAMP- and cGMP-dependent protein kinase phosphorylation site:
amino acids 67-71

N-myristoylation sites:
amino acids 17-23, 23-29, 27-33, 108-114, 118-124, 121-127

Amidation site:
amino acids 112-116

Small cytokines:
amino acids 51-91

FIGURE 261

```
GGGACTACAAGCCGCGCCGCGCTGCCGCTGGCCCCTCAGCAACCCTCGACATGGCGCTGA
GGCGGCCACCGCGACTCCGGCTCTGCGCTCGGCTGCCTGACTTCTTCCTGCTGCTGCTTT
TCAGGGGCTGCCTGATAGGGGCTGTAAATCTCAAATCCAGCAATCGAACCCCAGTGGTAC
AGGAATTTGAAAGTGTGGAACTGTCTTGCATCATTACGGATTCGCAGACAAGTGACCCCA
GGATCGAGTGGAAGAAAATTCAAGATGAACAAACCACATATGTGTTTTTTGACAACAAAA
TTCAGGGAGACTTGGCGGGTCGTGCAGAAATACTGGGGAAGACATCCCTGAAGATCTGGA
ATGTGACACGGAGAGACTCAGCCCTTTATCGCTGTGAGGTCGTTGCTCGAAATGACCGCA
AGGAAATTGATGAGATTGTGATCGAGTTAACTGTGCAAGTGAAGCCAGTGACCCCTGTCT
GTAGAGTGCCGAAGGCTGTACCAGTAGGCAAGATGGCAACACTGCACTGCCAGGAGAGTG
AGGGCCACCCCCGGCCTCACTACAGCTGGTATCGCAATGATGTACCACTGCCCACGGATT
CCAGAGCCAATCCCAGATTTCGCAATTCTTCTTTCCACTTAAACTCTGAAACAGGCACTT
TGGTGTTCACTGCTGTTCACAAGGACGACTCTGGGCAGTACTACTGCATTGCTTCCAATG
ACGCAGGCTCAGCCAGGTGTGAGGAGCAGGAGATGGAAGTCTATGACCTGAACATTGGCG
GAATTATTGGGGGGGTTCTGGTTGTCCTTGCTGTACTGGCCCTGATCACGTTGGGCATCT
GCTGTGCATACAGACGTGGCTACTTCATCAACAATAAACAGGATGGAGAAAGTTACAAGA
ACCCAGGGAAACCAGATGGAGTTAACTACATCCGCACTGACGAGGAGGGCGACTTCAGAC
ACAAGTCATCGTTTGTGATCTGAGACCCGCGGTGTGGCTGAGAGCGCACAGAGCGCACGT
GCACATACCTCTGCTAGAAACTCCTGTCAAGGCAGCGAGAGCTGATGCACTCGGACAGAG
CTAGACACTCATTCAGAAGCTTTTCGTTTTGGCCAAAGTTGACCACTACTCTTCTTACTC
TAACAAGCCACATGAATAGAAGAATTTTCCTCAAGATGGACCCGGTAAATATAACCACAA
GGAAGCGAAACTGGGTGCGTTCACTGAGTTGGGTTCCTAATCTGTTTCTGGCCTGATTCC
CGCATGAGTATTAGGGTGATCTTAAAGAGTTTGCTCACGTAAACGCCCGTGCTGGGCCCT
GTGAAGCCAGCATGTTCACCACTGGTCGTTCAGCAGCCACGACAGCACCATGTGAGATGG
CGAGGTGGCTGGACAGCACCAGCAGCGCATCCCGGCGGGAACCCAGAAAAGGCTTCTTAC
ACAGCAGCCTTACTTCATCGGCCCACAGACACCACCGCAGTTTCTTCTTAAAGGCTCTGC
TGATCGGTGTTGCAGTGTCCATTGTGGAGAAGCTTTTGGATCAGCATTTTGTAAAAACA
ACCAAAATCAGGAAGGTAAATTGGTTGCTGGAAGAGGGATCTTGCCTGAGGAACCCTGCT
TGTCCAACAGGGTGTCAGGATTTAAGGAAACCTTCGTCTTAGGCTAAGTCTGAAATGGT
ACTGAAATATGCTTTTCTATGGGTCTTGTTTATTTTATAAAATTTTACATCTAAATTTTT
GCTAAGGATGTATTTTGATTATTGAAAGAAAATTTCTATTTAAACTGTAAATATATTGT
CATACAATGTTAAATAACCTATTTTTTTAAAAAAGTTCAACTTAAGGTAGAAGTTCCAAG
CTACTAGTGTTAAATTGGAAAATATCAATAATTAAGAGTATTTTACCCAAGGAATCCTCT
CATGGAAGTTTACTGTGATGTTCCTTTTCTCACACAAGTTTTAGCCTTTTTCACAAGGGA
ACTCATACTGTCTACACATCAGACCATAGTTGCTTAGGAAACCTTTAAAAATTCCAGTTA
AGCAATGTTGAAATCAGTTTGCATCTCTTCAAAAGAAACCTCTCAGGTTAGCTTTGAACT
GCCTCTTCCTGAGATGACTAGGACAGTCTGTACCCAGAGGCCACCCAGAAGCCCTCAGAT
GTACATACACAGATGCCAGTCAGCTCCTGGGGTTGCGCCAGGCGCCCCGCTCTAGCTCA
CTGTTGCCTCGCTGTCTGCCAGGAGGCCCTGCCATCCTTGGGCCCTGGCAGTGGCTGTGT
CCCAGTGAGCTTTACTCACGTGGCCCTTGCTTCATCCAGCACAGCTCTCAGGTGGGCACT
GCAGGGACACTGGTGTCTTCCATGTAGCGTCCCAGCTTTGGGCTCCTGTAACAGACCTCT
TTTTGGTTATGGATGGCTCACAAAATAGGGCCCCAATGCTATTTTTTTTTTAAGTTT
GTTTAATTATTTGTTAAGATTGTCTAAGGCCAAAGGCAATTGCGAAATCAAGTCTGTCAA
GTACAATAACATTTTTAAAAGAAAATGGATCCCACTGTTCCTCTTTGCCACAGAGAAAGC
ACCCAGACGCCACAGGCTCTGTCGCATTTCAAAACAAACCATGATGGAGTGGCGGCCAGT
CCAGCCTTTTAAAGAACGTCAGGTGGAGCAGCCAGGTGAAAGGCCTGGCGGGGAGGAAAG
TGAAACGCCTGAATCAAAAGCAGTTTTCTAATTTTGACTTTAAATTTTTCATCCGCCGGA
```

FIGURE 261
(continued)

GACACTGCTCCCATTTGTGGGGGGACATTAGCAACATCACTCAGAAGCCTGTGTTCTTCA
AGAGCAGGTGTTCTCAGCCTCACATGCCCTGCCGTGCTGGACTCAGGACTGAAGTGCTGT
AAAGCAAGGAGCTGCTGAGAAGGAGCACTCCACTGTGTGCCTGGAGAATGGCTCTCACTA
CTCACCTTGTCTTTCAGCTTCCAGTGTCTTGGGTTTTTTATACTTTGACAGCTTTTTTTT
AATTGCATACATGAGACTGTGTTGACTTTTTTTAGTTATGTGAAACACTTTGCCGCAGGC
CGCCTGGCAGAGGCAGGAAATGCTCCAGCAGTGGCTCAGTGCTCCCTGGTGTCTGCTGCA
TGGCATCCTGGATGCTTAGCATGCAAGTTCCCTCCATCATTGCCACCTTGGTAGAGAGGG
ATGGCTCCCCACCCTCAGCGTTGGGGATTCACGCTCCAGCCTCCTTCTTGGTTGTCATAG
TGATAGGGTAGCCTTATTGCCCCCTCTTCTTATACCCTAAAACCTTCTACACTAGTGCCA
TGGGAACCAGGTCTGAAAAAGTAGAGAGAAGTGAAAGTAGAGTCTGGGAAGTAGCTGCCT
ATAACTGAGACTAGACGGAAAAGGAATACTCGTGTATTTTAAGATATGAATGTGACTCAA
GACTCGAGGCCGATACGAGGCTGTGATTCTGCCTTTGGATGGATGTTGCTGTACACAGAT
GCTACAGACTTGTACTAACACACCGTAATTTGGCATTTGTTTAACCTCATTTATAAAGC
TTCAAAAAAACCCA

FIGURE 262

MALRRPPRLRLCARLPDFFLLLLFRGCLIGAVNLKSSNRTPVVQEFESVELSCIITDSQT
SDPRIEWKKIQDEQTTYVFFDNKIQGDLAGRAEILGKTSLKIWNVTRRDSALYRCEVVAR
NDRKEIDEIVIELTVQVKPVTPVCRVPKAVPVGKMATLHCQESEGHPRPHYSWYRNDVPL
PTDSRANPRFRNSSFHLNSETGTLVFTAVHKDDSGQYYCIASNDAGSARCEEQEMEVYDL
NIGGIIGGVLVVLAVLALITLGICCAYRRGYFINNKQDGESYKNPGKPDGVNYIRTDEEG
DFRHKSSFVI

Important features of the protein:
Signal peptide:
amino acids 1-30

Transmembrane domain:
amino acids 243-263

N-glycosylation sites:
amino acids 104-107, 192-195 cAMP- and cGMP-dependent protein kinase phosphorylation site:
amino acids 107-110

Casein kinase II phosphorylation site:
amino acids 106-109, 296-299

Tyrosine kinase phosphorylation site:
amino acids 69-77

N-myristoylation sites:
amino acids 26-31, 215-220, 226-231, 243-248, 244-249, 262-267

FIGURE 263

```
CCAGGACCAGGGCGCACCGGCTCAGCCTCTCACTTGTCAGAGGCCGGGGAAGAGAAGCAA
AGCGCAACGGTGTGGTCCAAGCCGGGGCTTCTGCTTCGCCTCTAGGACATACACGGGACC
CCCTAACTTCAGTCCCCCAAACGCGCACCCTCGAAGTCTTGAACTCCAGCCCCGCACATC
CACGCGCGGCACAGGCGCGGCAGGCGGCAGGTCCCGGCCGAAGGCGATGCGCGCAGGGGG
TCGGGCAGCTGGGCTCGGGCGGCGGGAGTAGGGCCCGGCAGGGAGGCAGGGAGGCTGCAT
ATTCAGAGTCGCGGGCTGCGCCCTGGGCAGAGGCCGCCCTCGCTCCACGCAACACCTGCT
GCTGCCACCGCGCCGCGATGAGCCGCGTGGTCTCGCTGCTGCTGGGCGCCGCGCTGCTCT
GCGGCCACGGAGCCTTCTGCCGCCGCGTGGTCAGCGGCCAAAAGGTGTGTTTTGCTGACT
TCAAGCATCCCTGCTACAAAATGGCCTACTTCCATGAACTGTCCAGCCGAGTGAGCTTTC
AGGAGGCACGCCTGGCTTGTGAGAGTGAGGGAGGAGTCCTCCTCAGCCTTGAGAATGAAG
CAGAACAGAAGTTAATAGAGAGCATGTTGCAAAACCTGACAAAACCCGGGACAGGGATTT
CTGATGGTGATTTCTGGATAGGGCTTTGGAGGAATGGAGATGGGCAAACATCTGGTGCCT
GCCCAGATCTCTACCAGTGGTCTGATGGAAGCAATTCCCAGTACCGAAACTGGTACACAG
ATGAACCTTCCTGCGGAAGTGAAAAGTGTGTTGATGTATCACCAACCAACTGCCAATC
CTGGCCTTGGGGGTCCCTACCTTTACCAGTGGAATGATGACAGGTGTAACATGAAGCACA
ATTATATTTGCAAGTATGAACCAGAGATTAATCCAACAGCCCCTGTAGAAAAGCCTTATC
TTACAAATCAACCAGGAGACACCCATCAGAATGTGGTTGTTACTGAAGCAGGTATAATTC
CCAATCTAATTTATGTTGTTATACCAACAATACCCCTGCTCTTACTGATACTGGTTGCTT
TTGGAACCTGTTGTTTCCAGATGCTGCATAAAAGTAAAGGAAGAACAAAAACTAGTCCAA
ACCAGTCTACACTGTGGATTTCAAAGAGTACCAGAAAAGAAAGTGGCATGGAAGTATAAT
AACTCATTGACTTGGTTCCAGAATTTTGTAATTCTGGATCTGTATAAGGAATGGCATCAG
AACAATAGCTTGGAATGGCTTGAAATCACAAAGGATCTGCAAGATGAACTGTAAGCTCCC
CCTTGAGGCAAATATTAAAGTAATTTTTATATGTCTATTATTTCATTTAAAGAATATGCT
GTGCTAATAATGGAGTGAGACATGCTTATTTGCTAAAGGATGCACCCAAACTTCAAACT
TCAAGCAAATGAAATGGACAATGCAGATAAAGTTGTTATCAACACGTCGGGAGTATGTGT
GTTAGAAGCAATTCCTTTTATTTCTTTCACCTTTCATAAGTTGTTATCTAGTCAATGTAA
TGTATATTGTATTGAAATTTACAGTGTGCAAAAGTATTTTACCTTTGCATAAGTGTTTGA
TAAAAATGAACTGTTCTAATATTTATTTTTATGGCATCTCATTTTTCAATACATGCTCTT
TTGATTAAAGAAACTTATTACTGTTGTCAACTGAATTCACACACACAAATATAGTACC
ATAGAAAAAGTTTGTTTTCTCGAAATAATTCATCTTTCAGCTTCTCTGCTTTTGGTCAAT
GTCTAGGAAATCTCTTCAGAAATAAGAAGCTATTTCATTAAGTGTGATATAAACCTCCTC
AAACATTTTACTTAGAGGCAAGGATTGTCTAATTTCAATTGTGCAAGACATGTGCCTTAT
AATTATTTTAGCTTAAAATTAAACAGATTTTGTAATAATGTAACTTTGTTAATAGGTGC
ATAAACACTAATGCAGTCAATTTGAACAAAAGAAGTGACATACACAATATAAATCATATG
TCTTCACACGTTGCCTATATAATGAGAAGCAGCTCTCTGAGGGTTCTGAAATCAATGTGG
TCCCTCTCTTGCCCACTAAACAAGATGGTTGTTCGGGGTTTGGGATTGACACTGGAGGC
AGATAGTTGCAAAGTTAGTCTAAGGTTTCCCTAGCTGTATTTAGCCTCTGACTATATTAG
TATACAAAGAGGTCATGTGGTTGAGACCAGGTGAATAGTCACTATCAGTGTGGAGACAAG
CACAGCACACAGACATTTTAGGAAGGAAAGGAACTACGAAATCGTGTGAAAATGGGTTGG
AACCCATCAGTGATCGCATATTCATTGATGAGGGTTTGCTTGAGATAGAAAATGGTGGCT
CCTTTCTGTCTTATCTCCTAGTTTCTTCAATGCTTACGCCTTGTTCTTCTCAAGAGAAAG
TTGTAACTCTCTGGTCTTCATATGTCCCTGTGCTCCTTTTAACCAAATAAAGAGTTCTTG
TTTCTGGGGGAAAAAAAAAAAAAAAAAAAAAAAAAAAAAAAAAAAAAAA
```

FIGURE 264

MSRVVSLLLGAALLCGHGAFCRRVVSGQKVCFADFKHPCYKMAYFHELSSRVSFQEARLA
CESEGGVLLSLENEAEQKLIESMLQNLTKPGTGISDGDFWIGLWRNGDGQTSGACPDLYQ
WSDGSNSQYRNWYTDEPSCGSEKCVVMYHQPTANPGLGGPYLYQWNDDRCNMKHNYICKY
EPEINPTAPVEKPYLTNQPGDTHQNVVVTEAGIIPNLIYVVIPTIPLLLLILVAFGTCCF
QMLHKSKGRTKTSPNQSTLWISKSTRKESGMEV

Important features of the protein:
Signal peptide:
amino acids 1-21

Transmembrane domain:
amino acids 214-235

N-glycosylation sites:
amino acids 86-89 and 255-258 cAMP- and cGMP-dependent protein kinase phosphorylation site:
amino acids 266-269

N-myristoylation sites:
amino acids 27-32, 66-71, 91-96, 93-98, 102-107, 109-114, 140-145 and 212-217

FIGURE 265

```
GGAGAATGGAGAGAGCAGTGAGAGTGGAGTCCGGGGTCCTGGTCGGGGTGGTCTGTCTGC
TCCTGGCATGCCCTGCCACAGCCACTGGGCCCGAAGTTGCTCAGCCTGAAGTAGACACCA
CCCTGGGTCGTGTGCGAGGCCGGCAGGTGGGCGTGAAGGGCACAGACCGCCTTGTGAATG
TCTTTCTGGGCATTCCATTTGCCCAGCCGCCACTGGGCCCTGACCGGTTCTCAGCCCCAC
ACCCAGCACAGCCCTGGGAGGGTGTGCGGGATGCCAGCACTGCGCCCCAATGTGCCTAC
AAGACGTGGAGAGCATGAACAGCAGCAGATTTGTCCTCAACGGAAACAGCAGATCTTCT
CCGTTTCAGAGGACTGCCTGGTCCTCAACGTCTATAGCCCAGCTGAGGTCCCCGCAGGGT
CCGGTAGGCCGGTCATGGTATGGGTCCATGGAGGCGCTCTGATAACTGGCGCTGCCACCT
CCTACGATGGATCAGCTCTGGCTGCCTATGGGGATGTGGTCGTGGTTACAGTCCAGTACC
GCCTTGGGGTCCTTGGCTTCTTCAGCACTGGAGATGAGCATGCACCTGGCAACCAGGGCT
TCCTAGATGTGGTAGCTGCTTTGCGCTGGGTGCAAGAAAACATCGCCCCCTTCGGGGGTG
ACCTCAACTGTGTCACTGTCTTTGGTGGATCTGCCGGTGGGAGCATCATCTCTGGCCTGG
TCCTGTCCCCAGTGGCTGCAGGGCTGTTCCACAGAGCCATCACACAGAGTGGGGTCATCA
CCACCCCAGGGATCATCGACTCTCACCCTTGGCCCCTAGCTCAGAAAATCGCAAACACCT
TGGCCTGCAGCTCCAGCTCCCCGGCTGAGATGGTGCAGTGCCTTCAGCAGAAAGAAGGAG
AAGAGCTGGTCCTTAGCAAGAAGCTGAAAAATACTATCTATCCTCTCACCGTTGATGGCA
CTGTCTTCCCCAAAAGCCCCAAGGAACTCCTGAAGGAGAAGCCCTTCCACTCTGTGCCCT
TCCTCATGGGTGTCAACAACCATGAGTTCAGCTGGCTCATCCCCAGGGGCTGGGGTCTCC
TGGATACAATGGAGCAGATGAGCCGGGAGGACATGCTGGCCATCTCAACACCCGTCTTGA
CCAGTCTGGATGTGCCCCCTGAGATGATGCCCACCGTCATAGATGAATACCTAGGAAGCA
ACTCGGACGCACAAGCCAAATGCCAGGCGTTCCAGGAATTCATGGGTGACGTATTCATCA
ATGTTCCCACCGTCAGTTTTTCAAGATACCTTCGAGATTCTGGAAGCCCTGTCTTTTTCT
ATGAGTTCCAGCATCGACCCAGTTCTTTTGCGAAGATCAAACCTGCCTGGGTGAAGGCTG
ATCATGGGGCCGAGGGTGCTTTTGTGTTCGGAGGTCCCTTCCTCATGGACGAGAGCTCCC
GCCTGGCCTTTCCAGAGGCCACAGAGGAGGAGAAGCAGCTAAGCCTCACCATGATGGCCC
AGTGGACCCACTTTGCCCGGACAGGGGACCCCAATAGCAAGGCTCTGCCTCCTTGGCCCC
AATTCAACCAGGCGGAACAATATCTGGAGATCAACCCAGTGCCACGGGCCGGACAGAAGT
TCAGGGAGGCCTGGATGCAGTTCTGGTCAGAGACGCTCCCCAGCAAGATACAACAGTGGC
ACCAGAAGCAGAAGAACAGGAAGGCCCAGGAGGACCTCTGAGGCCAGGCCTGAACCTTCT
TGGCTGGGGCAAACCACTCTTCAAGTGGTGGCAGAGTCCCAGCACGGCAGCCCGCCTCTC
CCCCTGCTGAGACTTTAATCTCCACCAGCCCTTAAAGTGTCGGCCGCTCTGTGACTGGAG
TTATGCTCTTTTGAAATGTCACAAGGCCGCCTCCCACCTCTGGGCATTGTACAAGTTCT
TCCCTCTCCCTGAAGTGCCTTTCCTGCTTTCTTCGTGGTAGGTTCTAGCACATTCCTCTA
GCTTCCTGGAGGACTCACTCCCCAGGAAGCCTTCCCTGCCTTCTCTGGGCTGTGCGGCCC
CGAGTCTGCGTCCATTAGAGCACAGTCCACCCGAGGCTAGCACCGTGTCTGTGTCTGTCT
CCCCCTCAGAGGAGCTCTCTCAAAATGGGGATTAGCCTAACCCCACTCTGTCACCCACAC
CAGGATCGGGTGGGACCTGGAGCTAGGGGTGTTTGCTGAGTGAGTGAGTGAAACACAGA
ATATGGGAATGGCAGCTGCTGAACTTGAACCCAGAGCCTTCAGGTGCCAAAGCCATACTC
AGGCCCCCACCGACATTGTCCACCCTGGCCAGAAGGGTGCATGCCAATGGCAGAGACCTG
GGATGGGAGAAGTCCTGGGGCGCCAGGGGATCCAGCCTAGAGCAGACCTTAGCCCCTGAC
TAAGGCCTCAGACTAGGGCGGGAGGGGTCTCCTCCTCTCTGCTGCCCAGTCCTGGCCCCT
GCACAAGACAACAGAATCCATCAGGGCCATGAGTGTCACCCAGACCTGACCCTCACCAAT
TCCAGCCCCTGACCCTCAGGACGCTGGATGCCAGCTCCCAGCCCCAGTGCCGGGTCCTCC
CTCCCTTCCTGGCTTGGGGAGACCAGTTTCTGGGGAGCTTCCAAGAGCACCCACCAAGAC
ACAGCAGGACAGGCCAGGGAGGGCATCTGGACCAGGGCATCCGTCGGGCTATTGTCACA
GAGAAAAGAAGAGACCCACCCACTCGGGCTGCAAAAGGTGAAAAGCACCAAGAGGTTTTC
```

FIGURE 265
(continued)

```
AGATGGAAGTGAGAGGTGACAGTGTGCTGGCAGCCCTCACAGCCCTCGCTTGCTCTCCCT
GCCGCCTCTGCCTGGGCTCCCACTTTGGCAGCACTTGAGGAGCCCTTCAACCCGCCGCTG
CACTGTAGGAGCCCCTTTCTGGGCTGGCCAAGGCCGGAGCCAGCTCCCTCAGCTTGCGGG
GAGGTGCGGAGGGAGAGGGGCGGGCAGGAACCGGGGCTGCGCGCAGCGCTTGCGGGCCAG
AGTGAGTTCCGGGTGGGCGTGGGCTCGGCGGGGCCCCACTCAGAGCAGCTGGCCGGCCCC
AGGCAGTGAGGGCCTTAGCACCTGGGCCAGCAGCTGCTGTGCTCGATTTCTCGCTGGGCC
TTAGCTGCCTCCCCGCGGGGCAGGGCTCGGGACCTGCAGCCCTCCATGCCTGACCCTCCC
CCCACCCCCGTGGGCTCCTGTGCGGCCGGAGCCTCCCCAAGGAGCGCCGCCCCCTGCTC
CACAGCGCCCAGTCCCATCGACCACCCAAGGGCTGAGGAGTGCGGGTGCACAGCGCGGGA
CTGGCAGGCAGCTCCACCTGCTGCCCCAGTGCTGGATCCACTGGGTGAAGCCAGCTGGGC
TCCTGAGTCTGGTGGGGACTTGGAGAACCTTTATGTCTAGCTAAGGGATTGTAAATACAC
CGATGGGCACTCTGTATCTAGCTCAAGGTTTGTAAACACACCAATCAGCACCCTGTGTCT
AGCTCAGTGTTTGTGAATGCACCAATCCACACTCTGTATCTGGCTACTCTGGTGGGGACT
TGGAGAACCTTTGTGTCCACACTCTGTATCTAGCTAATCTAGTGGGGATGTGGAGAACCT
TTGTGTCTAGCTCAGGGATCGTAAACGCACCAATCAGCACCCTGTCAAAACAGACCACTT
GACTCTCTGTAAAATGGACCAATCAGCAGGATGTGGGTGGGGCGAGACAAGAGAATAAAA
GCAGGCTGCCTGAGCCAGCAGTGACAACCCCCTCGGGTCCCCTCCCACGCCGTGGAAGC
TTTGTTCTTTCGCTCTTTGCAATAAATCTTGCTACTGCCCAAAA
```

FIGURE 266

MERAVRVESGVLVGVVCLLLACPATATGPEVAQPEVDTTLGRVRGRQVGVKGTDRLVNVF
LGIPFAQPPLGPDRFSAPHPAQPWEGVRDASTAPPMCLQDVESMNSSRFVLNGKQQIFSV
SEDCLVLNVYSPAEVPAGSGRPVMVWVHGGALITGAATSYDGSALAAYGDVVVVTVQYRL
GVLGFFSTGDEHAPGNQGFLDVVAALRWVQENIAPFGGDLNCVTVFGGSAGGSIISGLVL
SPVAAGLFHRAITQSGVITTPGIIDSHPWPLAQKIANTLACSSSSPAEMVQCLQQKEGEE
LVLSKKLKNTIYPLTVDGTVFPKSPKELLKEKPFHSVPFLMGVNNHEFSWLIPRGWGLLD
TMEQMSREDMLAISTPVLTSLDVPPEMMPTVIDEYLGSNSDAQAKCQAFQEFMGDVFINV
PTVSFSRYLRDSGSPVFFYEFQHRPSSFAKIKPAWVKADHGAEGAFVFGGPFLMDESSRL
AFPEATEEEKQLSLTMMAQWTHFARTGDPNSKALPPWPQFNQAEQYLEINPVPRAGQKFR
EAWMQFWSETLPSKIQQWHQKQKNRKAQEDL

Important features of the protein:
Signal peptide:
amino acids 1-27

Transmembrane domain:
amino acids 226-245

N-glycosylation site:
amino acids 105-109

N-myristoylation sites:
amino acids 10-16, 49-55, 62-68, 86-92, 150-156, 155-161, 162-168, 217-223, 227-233, 228-234, 232-238, 262-268, 357-363, 461-467

Prokaryotic membrane lipoprotein lipid attachment site:
amino acids 12-23

Carboxylesterases type-B serine active site:
amino acids 216-232

FIGURE 267

```
TGTCGCCTGGCCCTCGCCATGCAGACCCCGCGAGCGTCCCCTCCCCGCCCGGCCCTCCTG
CTTCTGCTGCTGCTACTGGGGGGCGCCCACGGCCTCTTTCCTGAGGAGCCGCCGCCGCTT
AGCGTGGCCCCCAGGGACTACCTGAACCACTATCCCGTGTTTGTGGGCAGCGGGCCCGGA
CGCCTGACCCCGCAGAAGGTGCTGACGACCTCAACATCCAGCGAGTCCTGCGGGTCAAC
AGGACGCTGTTCATTGGGGACAGGGACAACCTCTACCGCGTAGAGCTGGAGCCCCCACG
TCCACGGAGCTGCGGTACCAGAGGAAGCTGACCTGGAGATCTAACCCCAGCGACATAAAC
GTGTGTCGGATGAAGGGCAAACAGGAGGGCGAGTGTCGAAACTTCGTAAAGGTGCTGCTC
CTTCGGGACGAGTCCACGCTCTTTGTGTGCGGTTCCAACGCCTTCAACCCGGTGTGCGCC
AACTACAGCATAGACACCCTGCAGCCCGTCGGAGACAACATCAGCGGTATGGCCCGCTGC
CCGTACGACCCCAAGCACGCCAATGTTGCCCTCTTCTCTGACGGGATGCTCTTCACAGCT
ACTGTTACCGACTTCCTAGCCATTGATGCTGTCATCTACCGCAGCCTCGGGGACAGGCCC
ACCCTGCGCACCGTGAAACATGACTCCAAGTGGTTCAAAGAGCCTTACTTTGTCCATGCG
GTGGAGTGGGGCAGCCATGTCTACTTCTTCTTCCGGGAGATTGCGATGGAGTTTAACTAC
CTGGAGAAGGTGGTGGTGTCCCGCGTGGCCCGAGTGTGCAAGAACGACGTGGGAGGCTCC
CCCCGCGTGCTGGAGAAGCAGTGGACGTCCTTCCTGAAGGCGCGGCTCAACTGCTCTGTA
CCCGGAGACTCCCATTTCTACTTCAACGTGCTGCAGGCTGTCACGGGCGTGGTCAGCCTC
GGGGGCCGGCCCGTGGTCCTGGCCGTTTTTTCCACGCCCAGCAACAGCATCCCTGGCTCG
GCTGTCTGCGCCTTTGACCTGACACAGGTGGCAGCTGTGTTTGAAGGCCGCTTCCGAGAG
CAGAAGTCCCCCGAGTCCATCTGGACGCCGGTGCCGGAGGATCAGGTGCCTCGACCCCGG
CCCGGGTGCTGCGCAGCCCCGGGATGCAGTACAATGCCTCCAGCGCCTTGCCGGATGAC
ATCCTCAACTTTGTCAAGACCCACCCTCTGATGGACGAGGCGGTGCCCTCGCTGGGCCAT
GCGCCCTGGATCCTGCGGACCCTGATGAGGCACCAGCTGACTCGAGTGGCTGTGGACGTG
GGAGCCGGCCCCTGGGGCAACCAGACCGTTGTCTTCCTGGGTTCTGAGGCGGGGACGGTC
CTCAAGTTCCTCGTCCGGCCCAATGCCAGCACCTCAGGGACGTCTGGGCTCAGTGTCTTC
CTGGAGGAGTTTGAGACCTACCGGCCGGACAGGTGTGGACGGCCCGGCGGTGGCGAGACA
GGGCAGCGGCTGCTGAGCTTGGAGCTGGACGCAGCTTCGGGGGGCCTGCTGGCTGCCTTC
CCCCGCTGCGTGGTCCGAGTGCCTGTGGCTCGCTGCCAGCAGTACTCGGGGTGTATGAAG
AACTGTATCGGCAGTCAGGACCCCTACTGCGGGTGGGCCCCCGACGGCTCCTGCATCTTC
CTCAGCCCGGGCACCAGAGCCGCCTTTGAGCAGGACGTGTCCGGGGCCAGCACCTCAGGC
TTAGGGGACTGCACAGGACTCCTGCGGGCCAGCCTCTCCGAGGACCGCGCGGGGCTGGTG
TCGGTGAACCTGCTGGTAACGTCGTCGGTGGCGGCCTTCGTGGTGGGAGCCGTGGTGTCC
GGCTTCAGCGTGGGCTGGTTCGTGGGCCTCCGTGAGCGGCGGGAGCTGGCCCGGCGCAAG
GACAAGGAGGCCATCCTGGCGCACGGGGCGGGCGAGGCGGTGCTGAGCGTCAGCCGCCTG
GGCGAGCGCAGGGCGCAGGGTCCCGGGGGCCGGGGCGGAGGCGGTGGCGGTGGCGCCGGG
GTTCCCCCGGAGGCCCTGCTGGCGCCCCTGATGCAGAACGGCTGGGCCAAGGCCACGCTG
CTGCAGGGCGGGCCCCACGACCTGGACTCGGGCTGCTGCCCACGCCCGAGCAGACGCCG
CTGCCGCAGAAGCGCCTGCCCACTCCGCACCCGCACCCCACGCCCTGGGCCCCGCGCC
TGGGACCACGGCCACCCCTGCTCCCGGCCTCCGCTTCATCCTCCCTCCTGCTGCTGGCG
CCCGCCCGGGCCCCGAGCAGCCCCCGCGCCTGGGGAGCCGACCCCGACGGCCGCCTC
TATGCTGCCCGGCCCGGCCGCGCCTCCCACGGCGACTTCCCGCTCACCCCCCACGCCAGC
CCGGACCGCCGGCGGGTGGTGTCCGCGCCCACGGGCCCCTTGGACCCAGCCTCAGCCGCC
GATGGCCTCCCGCGGCCCTGGAGCCCGCCCCGACGGGCAGCCTGAGGAGGCCACTGGGC
CCCCACGCCCCTCCGGCCGCCACCCTGCGCCGCACCCACACGTTCAACAGCGGCGAGGCC
CGGCCTGGGGACCGCCACCGCGGCTGCCACGCCCGGCCGGGCACAGACTTGGCCCACCTC
CTCCCCTATGGGGGGCGGACAGGACTGCGCCCCCGTGCCCTAGGCCGGGGGCCCCCCG
ATGCCTTGGCAGTGCCAGCCACGGGAACCAGGAGCGAGAGACGGTGCCAGAACGCCGGGG
CCCGGGGCAACTCCGAGTGGGTGCTCAAGTCCCCCCCGCGACCCACCCGCGGAGTGGGGG
```

FIGURE 267
(continued)

```
GCCCCCTCCGCCACAAGGAAGCACAACCAGCTCGCCCTCCCCCTACCCGGGGCCGCAGGA
CGCTGAGACGGTTTGGGGGTGGGTGGGCGGGAGGACTTTGCTATGGATTTGAGGTTGACC
TTATGCGCGTAGGTTTTGGTTTTTTTTTGCAGTTTTGGTTTCTTTTGCGGTTTTCTAACC
AATTGCACAACTCCGTTCTCGGGGTGGCGGCAGGCAGGGGAGGCTTGGACGCCGGTGGGG
AATGGGGGGCCACAGCTGCAGACCTAAGCCCTCCCCCACCCCTGGAAAGGTCCCTCCCCA
ACCCAGGCCCTGGCGTGTGTGGGTGTGCGTGCGTGTGCGTGCCGTGTTCGTGTGCAAGG
GGCCGGGGAGGTGGGCGTGTGTGTGCGTGCCAGCGAAGGCTGCTGTGGGCGTGTGTGTCA
AGTGGGCCACGCGTGCAGGGTGTGTGTCCACGAGCGACGATCGTGGTGGCCCCAGCGGCC
TGGGCGTTGGCTGAGCCGACGCTGGGGCTTCCAGAAGGCCCGGGGGTCTCCGAGGTGCCG
GTTAGGAGTTTGAACCCCCCCCACTCTGCAGAGGGAAGCGGGGACAATGCCGGGGTTTCA
GGCAGGAGACACGAGGAGGGCCTGCCCGGAAGTCACATCGGCAGCAGCTGTCTAAAGGGC
TTGGGGGCCTGGGGGGCGGCGAAGGTGGGTGGGGCCCTCTGTAAATACGGCCCCAGGGT
GGTGAGAGAGTCCCATGCCACCCGTCCCCTTGTGACCTCCCCCCTATGACCTCCAGCTGA
CCATGCATGCCACGTGGCTGGCTGGGTCCTCTGCCCTCTTTGGAGTTTGCCTCCCCAGC
CCCCTCCCCATCAATAAAACTCTGTTTACAACCAAAAAAAAAAAAAAAAAAAAAAAAAAA
```

FIGURE 268

```
MQTPRASPPRPALLLLLLLLLGGAHGLFPEEPPPLSVAPRDYLNHYPVFVGSGPGRLTPAE
GADDLNIQRVLRVNRTLFIGDRDNLYRVELEPPTSTELRYQRKLTWRSNPSDINVCRMKG
KQEGECRNFVKVLLLRDESTLFVCGSNAFNPVCANYSIDTLQPVGDNISGMARCPYDPKH
ANVALFSDGMLFTATVTDFLAIDAVIYRSLGDRPTLRTVKHDSKWFKEPYFVHAVEWGSH
VYFFFREIAMEFNYLEKVVVSRVARVCKNDVGGSPRVLEKQWTSFLKARLNCSVPGDSHF
YFNVLQAVTGVVSLGGRPVVLAVFSTPSNSIPGSAVCAFDLTQVAAVFEGRFREQKSPES
IWTPVPEDQVPRPRPGCCAAPGMQYNASSALPDDILNFVKTHPLMDEAVPSLGHAPWILR
TLMRHQLTRVAVDVGAGPWGNQTVVFLGSEAGTVLKFLVRPNASTSGTSGLSVFLEEFET
YRPDRCGRPGGGETGQRLLSLELDAASGGLLAAFPRCVVRVPVARCQQYSGCMKNCIGSQ
DPYCGWAPDGSCIFLSPGTRAAFEQDVSGASTSGLGDCTGLLRASLSEDRAGLVSVNLLV
TSSVAAFVVGAVVSGFSVGWFVGLRERRELARRKDKEAILAHGAGEAVLSVSRLGERRAQ
GPGGRGGGGGGAGVPPEALLAPLMQNGWAKATLLQGGPHDLDSGLLPTPEQTPLPQKRL
PTPHPHPHALGPRAWDHGHPLLPASASSSLLLLAPARAPEQPPAPGEPTPDGRLYAARPG
RASHGDFPLTPHASPDRRRVVSAPTGPLDPASAADGLPRPWSPPPTGSLRRPLGPHAPPA
ATLRRTHTFNSGEARPGDRHRGCHARPGTDLAHLLPYGGADRTAPPVP
```

Important features of the protein:
Signal peptide:
amino acids 1-25

Transmembrane domains:
amino acids 318-339, 598-617

N-glycosylation sites.
amino acids 74-78, 155-159, 167-171, 291-295, 386-390, 441-445, 462-466

Glycosaminoglycan attachment sites:
amino acids 51-55, 573-577 cAMP- and cGMP-dependent protein kinase phosphorylation site:
amino acids 102-106

N-myristoylation sites:
amino acids 21-27, 50-56, 189-195, 333-339, 382-388, 448-454, 490-496, 491-497, 508-514, 509-515, 531-537, 558-564, 569-575, 574-580, 580-586, 610-616, 643-649, 663-669, 666-672, 667-673, 668-674, 669-675, 670-676, 868-874, 879-885

FIGURE 269

ATCTGAGTGAGCTAACTGACACAATGAAACTGTCAGGCATGTTTCTGCTCCTCTCTCTGG
CTCTTTTCTGCTTTTTAACAGGTGTCTTCAGTCAGGGAGGACAGGTTGACTGTGGTGAGT
TCCAGGACCCCAAGGTCTACTGCACTCGGGAATCTAACCCACACTGTGGCTCTGATGGCC
AGACATATGGCAATAAATGTGCCTTCTGTAAGGCCATAGTGAAAAGTGGTGGAAAGATTA
GCCTAAAGCATCCTGGAAAATGCTGAGTTAAAGCCAATGTTTCTTGGTGACTTGCCAGCT
TTTGCAGCCTTCTTTTCTCACTTCTGCTTATACTTTTGCTGGTGGATTCCTTTAATTCAT
AAAGACATACCTACTCTGCCTGGGTCTTGAGGAGTTCAATGTATGTCTATTTCTCTTGAT
TCACTTGTCAATAAAGTACATTCTGCAAAAGCAAAAA

FIGURE 270

MKLSGMFLLLSLALFCFLTGVFSQGGQVDCGEFQDPKVYCTRESNPHCGSDGQTYGNKCA
FCKAIVKSGGKISLKHPGKC

Important features of the protein:
Signal peptide:
amino acids 1-23

N-myristoylation sites:
amino acids 26-32, 52-58, 56-62, 69-75

Kazal serine protease inhibitors family signature:
amino acids 40-63

FIGURE 271

AACTTCTAC<u>ATG</u>GGCCTCCTGCTGCTGGTGCTCTTCCTCAGCCTCCTGCCGGTGGCCTAC
ACCATCATGTCCCTCCCACCCTCCTTTGACTGCGGGCCGTTCAGGTGCAGAGTCTCAGTT
GCCCGGGAGCACCTCCCCTCCCGAGGCAGTCTGCTCAGAGGGCCTCGGCCCAGAATTCCA
GTTCTGGTTTCATGCCAGCCTGTAAAAGGCCATGGAACTTTGGGTGAATCACCGATGCCA
TTTAAGAGGGTTTTCTGCCAGGATGGAAATGTTAGGTCGTTCTGTGTCTGCGCTGTTCAT
TTCAGTAGCCACCAGCCACCTGTGGCCGTTGAGTGCTTGAAA<u>TGA</u>GGAACTGAGAAAATT
AATTTCTCATGTATTTTTCTCATTTATTTATTAATTTTTAACTGATAGTTGTACATATTT
GGGGGTACATGTGATATTTGGATACATGTATACAATATATAATGATCAAATCAGGGTAAC
TGGGATATCCATCACATCAAACATTTATTTTTATTCTTTTTAGACAGAGTCTCACTCTG
TCACCCAGGCTGGAGTGCAGTGGTGCCATCTCAGCTTACTGCAACCTCTGCCTGCCAGGT
TCAAGCGATTCTCATGCCTCCACCTCCCAAGTAGCTGGGACTACAGGCATGCACCACAAT
GCCCAACTAATTTTTGTATTTTTAGTAGAGACGGGGTTTTGCCATGTTGCCCAGGCTGGC
CTTGAACTCCTGGCCTCAAACAATCCACTTGCCTCGGCCTCCCAAAGTGTTATGATTACA
GGCGTGAGCCACCGTGCCTGGCCTAAACATTTATCTTTTCTTTGTGTTGGGAACTTTGAA
ATTATACAATGAATTATTGTTAACTGTCATCTCCCTGCTGTGCTATGGAACACTGGGACT
TCTTCCCTCTATCTAACTGTATATTTGTACCAGTTAACCAACCGTACTTCATCCCCACTC
CTCTCTATCCTTCCCAACCTCTGATCACCTCATTCTACTCTACCTCCATGAGATCCAC
TTTTTTAGCTCCCACATGTGAGTAAGAAATGCAATATTTGTCTTTCTGTGCCTGGCTTA
TTTCACTTAACATAATGACTTCCTGTTCCATCCATGTTGCTGCAAATGACAGGATTTCGT
TCTTAATTTCAATTAAAATAACCACACATGGCAAAAA

FIGURE 272

MGLLLLVLFLSLLPVAYTIMSLPPSFDCGPFRCRVSVAREHLPSRGSLLRGPRPRIPVLV
SCQPVKGHGTLGESPMPFKRVFCQDGNVRSFCVCAVHFSSHQPPVAVECLK

Important features of the protein:
Signal peptide:
amino acids 1-18

N-myristoylation site:
amino acids 86-92

Zinc carboxypeptidases, zinc-binding region 2 signature:
amino acids 68-79

FIGURE 273

```
TTCTGAAGTAACGGAAGCTACCTTGTATAAAGACCTCAACACTGCTGACCATGATCAGCG
CAGCCTGGAGCATCTTCCTCATCGGGACTAAAATTGGGCTGTTCCTTCAAGTAGCACCTC
TATCAGTTATGGCTAAATCCTGTCCATCTGTGTCGCTGCGATGCGGGTTTCATTTACT
GTAATGATCGCTTTCTGACATCCATTCCAACAGGAATACCAGAGGATGCTACAACTCTCT
ACCTTCAGAACAACCAAATAAATAATGCTGGGATTCCTTCAGATTTGAAAAACTTGCTGA
AAGTAGAAAGAATATACCTATACCACAACAGTTTAGATGAATTTCCTACCAACCTCCCAA
AGTATGTAAAAGAGTTACATTTGCAAGAAAATAACATAAGGACTATCACTTATGATTCAC
TTTCAAAAATTCCCTATCTGGAAGAATTACATTTAGATGACAACTCTGTCTCTGCAGTTA
GCATAGAAGAGGGAGCATTCCGAGACAGCAACTATCTCCGACTGCTTTTCCTGTCCCGTA
ATCACCTTAGCACAATTCCCTGGGGTTTGCCCAGGACTATAGAAGAACTACGCTTGGATG
ATAATCGCATATCCACTATTTCATCACCATCTCTTCAAGGTCTCACTAGTCTAAAACGCC
TGGTTCTAGATGGAAACCTGTTAACAATCATGGTTTAGGTGACAAAGTTTTCTTCAACC
TAGTTAATTTGACAGAGCTGTCCCTGGTGCGGAATTCCCTGACTGCTGCACCAGTAAACC
TTCCAGGCACAAACCTGAGGAAGCTTTATCTTCAAGATAACCACATCAATCGGGTGCCCC
CAAATGCTTTTTCTTATCTAAGGCAGCTCTATCGACTGGATATGTCCAATAATAACCTAA
GTAATTTACCTCAGGGTATCTTTGATGATTTGGACAATATAACACAACTGATTCTTCGCA
ACAATCCCTGGTATTGCGGGTGCAAGATGAAATGGGTACGTGACTGGTTACAATCACTAC
CTGTGAAGGTCAACGTGCGTGGGCTCATGTGCCAAGCCCCAGAAAAGGTTCGTGGGATGG
CTATTAAGGATCTCAATGCAGAACTGTTTGATTGTAAGGACAGTGGGATTGTAAGCACCA
TTCAGATAACCACTGCAATACCCAACACAGTGTATCCTGCCCAAGGACAGTGGCCAGCTC
CAGTGACCAAACAGCCAGATATTAAGAACCCCAAGCTCACTAAGGATCAACAAACCACAG
GGAGTCCCTCAAGAAAACAATTACAATTACTGTGAAGTCTGTCACCTCTGATACCATTC
ATATCTCTTGGAAACTTGCTCTACCTATGACTGCTTTGAGACTCAGCTGGCTTAAACTGG
GCCATAGCCCGGCATTTGGATCTATAACAGAAACAATTGTAACAGGGGAACGCAGTGAGT
ACTTGGTCACAGCCCTGGAGCCTGATTCACCCTATAAAGTATGCATGGTTCCCATGGAAA
CCAGCAACCTCTACCTATTTGATGAAACTCCTGTTTGTATTGAGACTGAAACTGCACCCC
TTCGAATGTACAACCCTACAACCACCCTCAATCGAGAGCAAGAGAAAGAACCTTACAAAA
ACCCCAATTTACCTTTGGCTGCCATCATTGGTGGGGCTGTGGCCCTGGTTACCATTGCCC
TTCTTGCTTTAGTGTGTTGGTATGTTCATAGGAATGGATCGCTCTTCTCAAGGAACTGTG
CATATAGCAAAGGGAGGAGAAGAAAGGATGACTATGCAGAAGCTGGCACTAAGAAGGACA
ACTCTATCCTGGAAATCAGGGAAACTTCTTTTCAGATGTTACCAATAAGCAATGAACCCA
TCTCGAAGGAGGAGTTTGTAATACACACCATATTTCCTCCTAATGGAATGAATCTGTACA
AAAACAATCACAGTGAAAGCAGTAGTAACCGAAGCTACAGAGACAGTGGTATTCCAGACT
CAGATCACTCACACTCATGATGCTGAAGGACTCACAGCAGACTTGTGTTTTGGGTTTTTT
AAACCTAAGGGAGGTGATGGT
```

FIGURE 274

```
MISAAWSIFLIGTKIGLFLQVAPLSVMAKSCPSVCRCDAGFIYCNDRFLTSIPTGIPEDA
TTLYLQNNQINNAGIPSDLKNLLKVERIYLYHNSLDEFPTNLPKYVKELHLQENNIRTIT
YDSLSKIPYLEELHLDDNSVSAVSIEEGAFRDSNYLRLLFLSRNHLSTIPWGLPRTIEEL
RLDDNRISTISSPSLQGLTSLKRLVLDGNLLNNHGLGDKVFFNLVNLTELSLVRNSLTAA
PVNLPGTNLRKLYLQDNHINRVPPNAFSYLRQLYRLDMSNNNLSNLPQGIFDDLDNITQL
ILRNNPWYCGCKMKWVRDWLQSLPVKVNVRGLMCQAPEKVRGMAIKDLNAELFDCKDSGI
VSTIQITTAIPNTVYPAQGQWPAPVTKQPDIKNPKLTKDQQTTGSPSRKTITITVKSVTS
DTIHISWKLALPMTALRLSWLKLGHSPAFGSITETIVTGERSEYLVTALEPDSPYKVCMV
PMETSNLYLFDETPVCIETETAPLRMYNPTTTLNREQEKEPYKNPNLPLAAIIGGAVALV
TIALLALVCWYVHRNGSLFSRNCAYSKGRRRKDDYAEAGTKKDNSILEIRETSFQMLPIS
NEPISKEEFVIHTIFPPNGMNLYKNNHSESSSNRSYRDSGIPDSDHSHS
```

Important features of the protein:
Signal peptide:
amino acids 1-28

Transmembrane domain:
amino acids 531-552

N-glycosylation sites:
amino acids 226-229, 282-285, 296-299, 555-558, 626-629, 633-636

Tyrosine kinase phosphorylation site:
amino acids 515-522

N-myristoylation sites:
amino acids 12-17, 172-177, 208-213, 359-364, 534-539, 556-561, 640-645

Amidation site:
amino acids 567-570

Leucine zipper pattern:
amino acids 159-180

Phospholipase A2 aspartic acid active site:
amino acids 34-44

FIGURE 275

```
AGGGCCCGCGGGTGGAGAGAGCGACGCCCGAGGGGATGGCGGCAGCGTCCCGGAGCGCCT
CTGGCTGGGCGCTACTGCTGCTGGTGGCACTTTGGCAGCAGCGCGCGGCCGGCTCCGGCG
TCTTCCAGCTGCAGCTGCAGGAGTTCATCAACGAGCGCGGCGTACTGGCCAGTGGGCGGC
CTTGCGAGCCCGGCTGCCGGACTTTCTTCCGCGTCTGCCTTAAGCACTTCCAGGCGGTCG
TCTCGCCCGGACCCTGCACCTTCGGGACCGTCTCCACGCCGGTATTGGGCACCAACTCCT
TCGCTGTCCGGGACGACAGTAGCGGCGGGGGGCGCAACCCTCTCCAACTGCCCTTCAATT
TCACCTGGCCGGGTACCTTCTCGCTCATCATCGAAGCTTGGCACGCGCCAGGAGACGACC
TGCGGCCAGAGGCCTTGCCACCAGATGCACTCATCAGCAAGATCGCCATCCAGGGCTCCC
TAGCTGTGGGTCAGAACTGGTTATTGGATGAGCAAACCAGCACCCTCACAAGGCTGCGCT
ACTCTTACCGGGTCATCTGCAGTGACAACTACTATGGAGACAACTGCTCCCGCCTGTGCA
AGAAGCGCAATGACCACTTCGGCCACTATGTGTGCCAGCCAGATGGCAACTTGTCCTGCC
TGCCCGGTTGGACTGGGGAATATTGCCAACAGCCTATCTGTCTTTCGGGCTGTCATGAAC
AGAATGGCTACTGCAGCAAGCCAGCAGAGTGCCTCTGCCGCCCAGGCTGGCAGGGCCGGC
TGTGTAACGAATGCATCCCCCACAATGGCTGTCGCCACGGCACCTGCAGCACTCCCTGGC
AATGTACTTGTGATGAGGGCTGGGGAGGCCTGTTTTGTGACCAAGATCTCAACTACTGCA
CCCACCACTCCCCATGCAAGAATGGGGCAACGTGCTCCAACAGTGGGCAGCGAAGCTACA
CCTGCACCTGTCGCCCAGGCTACACTGGTGTGGACTGTGAGCTGGAGCTCAGCGAGTGTG
ACAGCAACCCCTGTCGCAATGGAGGCAGCTGTAAGGACCAGGAGGATGGCTACCACTGCC
TGTGTCCTCCGGGCTACTATGGCCTGCACTGTGAACACAGCACCTTGAGCTGCGCCGACT
CCCCCTGCTTCAATGGGGGCTCCTGCCGGGAGCGCAACCAGGGGCCAACTATGCTTGTG
AATGTCCCCCCAACTTCACCGGCTCCAACTGCGAGAAGAAAGTGGACAGGTGCACCAGCA
ACCCCTGTGCCAACGGGGACAGTGCCTGAACCGAGGTCCAAGCCGCATGTGCCGCTGCC
GTCCTGGATTCACGGGCACCTACTGTGAACTCCACGTCAGCGACTGTGCCCGTAACCCTT
GCGCCCACGGTGGCACTTGCCATGACCTGGAGAATGGGCTCATGTGCACCTGCCCTGCCG
GCTTCTCTGGCCGACGCTGTGAGGTGCGGACATCCATCGATGCCTGTGCCTCGAGTCCCT
GCTTCAACAGGGCCACCTGCTACACCGACCTCTCCACAGACACCTTTGTGTGCAACTGCC
CTTATGGCTTTGTGGGCAGCCGCTGCGAGTTCCCCGTGGGCTTGCCGCCCAGCTTCCCCT
GGGTGGCCGTCTCGCTGGGTGTGGGGCTGGCAGTGCTGCTGGTACTGCTGGGCATGGTGG
CAGTGGCTGTGCGGCAGCTGCGGCTTCGACGGCCGGACGACGGCAGCAGGGAAGCCATGA
ACAACTTGTCGGACTTCCAGAAGGACAACCTGATTCCTGCCGCCCAGCTTAAAAACACAA
ACCAGAAGAAGGAGCTGGAAGTGGACTGTGGCCTGGACAAGTCCAACTGTGGCAAACAGC
AAAACCACACATTGGACTATAATCTGGCCCCAGGGCCCTGGGCGGGGGACCATGCCAG
GAAAGTTTCCCCACAGTGACAAGAGCTTAGGAGAGAAGGCGCCACTGCGGTTACACAGTG
AAAAGCCAGAGTGTCGGATATCAGCGATATGCTCCCCAGGGACTCCATGTACCAGTCTG
TGTGTTTGATATCAGAGGAGAGGAATGAATGTGTCATTGCCACGGAGGTATAAGGCAGGA
GCCTACCTGGACATCCCTGCTCAGCCCCGCGGCTGGACCTTCCTTCTGCATTGTTTACA
```

FIGURE 276

```
MAAASRSASGWALLLLVALWQQRAAGSGVFQLQLQEFINERGVLASGRPCEPGCRTFFRV
CLKHFQAVVSPGPCTFGTVSTPVLGTNSFAVRDDSSGGGRNPLQLPFNFTWPGTFSLIIE
AWHAPGDDLRPEALPPDALISKIAIQGSLAVGQNWLLDEQTSTLTRLRYSYRVICSDNYY
GDNCSRLCKKRNDHFGHYVCQPDGNLSCLPGWTGEYCQQPICLSGCHEQNGYCSKPAECL
CRPGWQGRLCNECIPHNGCRHGTCSTPWQCTCDEGWGGLFCDQDLNYCTHHSPCKNGATC
SNSGQRSYTCTCRPGYTGVDCELELSECDSNPCRNGGSCKDQEDGYHCLCPPGYYGLHCE
HSTLSCADSPCFNGGSCRERNQGANYACECPPNFTGSNCEKKVDRCTSNPCANGGQCLNR
GPSRMCRCRPGFTGTYCELHVSDCARNPCAHGGTCHDLENGLMCTCPAGFSGRRCEVRTS
IDACASSPCFNRATCYTDLSTDTFVCNCPYGFVGSRCEFPVGLPPSFPWVAVSLGVGLAV
LLVLLGMVAVAVRQLRLRRPDDGSREAMNNLSDFQKDNLIPAAQLKNTNQKKELEVDCGL
DKSNCGKQQNHTLDYNLAPGPLGRGTMPGKFPHSDKSLGEKAPLRLHSEKPECRISAICS
PRDSMYQSVCLISEERNECVIATEV
```

Important features of the protein:
Signal peptide:
amino acids 1-26

Transmembrane domain:
amino acids 530-552

N-glycosylation sites:
amino acids 108-112, 183-187, 205-209, 393-397, 570-574, 610-614

Glycosaminoglycan attachment site:
amino acids 96-100

Tyrosine kinase phosphorylation site:
amino acids 340-347

N-myristoylation sites:
amino acids 42-48, 204-210, 258-264, 277-283, 297-303, 383-389, 415-421, 461-467, 522-528, 535-541, 563-569, 599-605, 625-631

Amidation site:
amino acids 471-475

Aspartic acid and asparagine hydroxylation site:
amino acids 339-351

EGF-like domain cysteine pattern signature:
amino acids 173-185, 206-218, 239-251, 270-282, 310-322, 348-360, 388-400, 426-438, 464-476, 506-518

Calcium-binding EGF-like:
amino acids 224-245, 255-276, 295-316, 333-354, 373-394, 411-432, 449-470

FIGURE 277

GGCAGTGCAGCCGCCTCACAGGTCGGCGGACGGGCCAGGCGGGCGGCCTCCTGAACCGAA
CCGAATCGGCTCCTCGGGCCGTCGTCCTCCCGCCCCTCCTCGCCCGCCGCCGGAGTTTTC
TTTCGGTTTCTTCCAAGATTCCTGGCCTTCCCTCGACGGAGCCGGGCCCAGTGCGGGGGC
GCAGGGCGCGGGAGCTCCACCTCCTCGGCTTTCCCTGCGTCCAGAGGCTGGCATGGCGCG
GGCCGAGTACTGAGCGCACGGTCGGGGCACAGCAGGGCCGGGGGGTGCAGCTGGCTCGCG
CCTCCTCTCCGGCCGCCGTCTCCTCCGGTCCCTGGCGAAAGCCATTGAGACACCAGCTGG
ACGTCACGCGCCGGAGCATGTCTGGGAGTCAGAGCGAGGTGGCTCCATCCCCGCAGAGTC
CGCGGAGCCCCGAGATGGGACGGGACTTGCGGCCCGGGTCCCGCGTGCTCCTGCTCCTGC
TTCTGCTCCTGCTGGTGTACCTGACTCAGCCAGGCAATGGCAACGAGGGCAGCGTCACTG
GAAGTTGTTATTGTGGTAAAAGAATTTCTTCCGACTCCCCGCCATCGGTTCAGTTCATGA
ATCGTCTCCGGAAACACCTGAGAGCTTACCATCGGTGTCTATACTACACGAGGTTCCAGC
TCCTTTCCTGGAGCGTGTGTGGGGGCAACAAGGACCCATGGGTTCAGGAATTGATGAGCT
GTCTTGATCTCAAAGAATGTGGACATGCTTACTCGGGGATTGTGGCCCACCAGAAGCATT
TACTTCCTACCAGCCCCCCAATTTCTCAGGCCTCAGAGGGGCATCTTCAGATATCCACA
CCCCTGCCCAGATGCTCCTGTCCACCTTGCAGTCCACTCAGCGCCCCACCCTCCCAGTAG
GATCACTGTCCTCGGACAAAGAGCTCACTCGTCCCAATGAAACCACCATTCACACTGCGG
GCCACAGTCTGGCAGCTGGGCCTGAGGCTGGGGAGAACCAGAAGCAGCCGGAAAAAAATG
CTGGTCCCACAGCCAGGACATCAGCCACAGTGCCAGTCCTGTGCCTCCTGGCCATCATCT
TCATCCTCACCGCAGCCCTTTCCTATGTGCTGTGCAAGAGGAGGAGGGGGCAGTCACCGC
AGTCCTCTCCAGATCTGCCGGTTCATTATATACCTGTGGCACCTGACTCTAATACCTGAG
CCAAGAATGGAAGCTTGTGAGGGTAAACTGTGGCTTATTCTTACAAAAAGTGTAATAAAG
GAGACTGACCCCTGACAACATGGTAGGCACTGTAAAAAAAAAAAAAA

FIGURE 278

```
MGRDLRPGSRVLLLLLLLLLLVYLTQPGNGNEGSVTGSCYCGKRISSDSPPSVQFMNRLRK
HLRAYHRCLYYTRFQLLSWSVCGGNKDPWVQELMSCLDLKECGHAYSGIVAHQKHLLPTS
PPISQASEGASSDIHTPAQMLLSTLQSTQRPTLPVGSLSSDKELTRPNETTIHTAGHSLA
AGPEAGENQKQPEKNAGPTARTSATVPVLCLLAIIFILTAALSYVLCKRRRGQSPQSSPD
LPVHYIPVAPDSNT
```

Important features of the protein:

Signal peptide:
1-26

Transmembrane domain:
204-223

N-glycosylation site:
168-172 cAMP- and cGMP-dependent protein kinase phosphorylation site:
42-46

N-myristoylation site:
29-35, 32-38, 36-42, 156-162

Amidation site:
40-44

FIGURE 279

```
CGCGAGGCGCGGGGAGCCTGGGACCAGGAGCGAGAGCCGCCTACCTGCAGCCGCCGCCCA
CGGCACGGCAGCCACCATGGCGCTCCTGCTGTGCTTCGTGCTCCTGTGCGGAGTAGTGGA
TTTCGCCAGAAGTTTGAGTATCACTACTCCTGAAGAGATGATTGAAAAAGCCAAAGGGGA
AACTGCCTATCTGCCATGCAAATTTACGCTTAGTCCCGAAGACCAGGGACCGCTGGACAT
CGAGTGGCTGATATCACCAGCTGATAATCAGAAGGTGGATCAAGTGATTATTTTATATTC
TGGAGACAAAATTTATGATGACTACTATCCAGATCTGAAAGGCCGAGTACATTTTACGAG
TAATGATCTCAAATCTGGTGATGCATCAATAAATGTAACGAATTTACAACTGTCAGATAT
TGGCACATATCAGTGCAAAGTGAAAAAAGCTCCTGGTGTTGCAAATAAGAAGATTCATCT
GGTAGTTCTTGTTAAGCCTTCAGGTGCGAGATGTTACGTTGATGGATCTGAAGAAATTGG
AAGTGACTTTAAGATAAAATGTGAACCAAAAGAAGGTTCACTTCCATTACAGTATGAGTG
GCAAAAATTGTCTGACTCACAGAAAATGCCCACTTCATGGTTAGCAGAAATGACTTCATC
TGTTATATCTGTAAAAAATGCCTCTTCTGAGTACTCTGGGACATACAGCTGTACAGTCAG
AAACAGAGTGGGCTCTGATCAGTGCCTGTTGCGTCTAAACGTTGTCCCTCCTTCAAATAA
AGCTGGACTAATTGCAGGAGCCATTATAGGAACTTTGCTTGCTCTAGCGCTCATTGGTCT
TATCATCTTTTGCTGTCGTAAAAAGCGCAGAGAAGAAAAATATGAAAAGGAAGTTCATCA
CGATATCAGGGAAGATGTGCCACCTCCAAAGAGCCGTACGTCCACTGCCAGAAGCTACAT
CGGCAGTAATCATTCATCCCTGGGGTCCATGTCTCCTTCCAACATGGAAGGATATTCCAA
GACTCAGTATAACCAAGTACCAAGTGAAGACTTTGAACGCACTCCTCAGAGTCCGACTCT
CCCACCTGCTAAGTTCAAGTACCCTTACAAGACTGATGGAATTACAGTTGTATAAATATG
GACTACTGAAGAATCTGAAGTATTGTATTATTTGACTTTATTTTAGGCCTCTAGTAAAGA
CTTAAATGTTTTTTAAAAAAAGCACAAGGCACAGAGATTAGAGCAGCTGTAAGAACACAT
CTACTTTATGCAATGGCATTAGACATGTAAGTCAGATGTCATGTCAAAATTAGTACGAGC
CAAATTCTTTGTTAAAAAACCCTATGTATAGTGACACTGATAGTTAAAAGATGTTTTATT
ATATTTTCAATAACTACCACTAACAAATTTTTAACTTTTCATATGCATATTCTGATATGT
GGTCTTTTAGGAAAGTATGGTTAATAGTTGATTTTTCAAAGGAAATTTTAAAATTCTTA
CGTTCTGTTTAATGTTTTTGCTATTTAGTTAAATACATTGAAGGGAAATACCCGTTCTTT
TCCCCTTTTATGCACACAACAGAAACACGCGTTGTCATGCCTCAAACTATTTTTATTTG
CAACTACATGATTTCACACAATTCTCTTAAACAACGACATAAAATAGATTTCCTTGTATA
TAAATAACTTACATACGCTCCATAAAGTAAATTCTCAAAGGTGCTAGAACAAATCGTCCA
CTTCTACAGTGTTCTCGTATCCAACAGAGTTGATGCACAATATATAAATACTCAAGTCCA
ATATTAAAAACTTAGGCACTTGACTAACTTTAATAAAATTTCTCAAACTATATCAATATC
TAAAGTGCATATATTTTTTAAGAAAGATTATTCTCAATAACTTCTATAAAAATAAGTTTG
ATGGTTTGGCCCATCTAACTTCACTACTATTAGTAAGAACTTTTAACTTTTAATGTGTAG
TAAGGTTTATTCTACCTTTTTCTCAACATGACACCAACACAATCAAAAACGAAGTTAGTG
AGGTGCTAACATGTGAGGATTAATCCAGTGATTCCGGTCACAATGCATTCCAGGAGGAGG
TACCCATGTCACTGGAATTGGGCGATATGGTTTATTTTTTCTTCCCTGATTTGGATAACC
AAATGGAACAGGAGGAGGATAGTGATTCTGATGGCCATTCCCTCGATACATTCCTGGCTT
TTTTCTGGGCAAAGGGTGCCACATTGGAAGAGGTGGAAATATAAGTTCTGAAATCTGTAG
GGAAGAGAACACATTAAGTTAATTCAAAGGAAAAAATCATCATCTATGTTCCAGATTTCT
CATTAAAGACAAAGTTACCCACAACACTGAGATCACATCTAAGTGACACTCCTATTGTCA
GGTCTAAATACATTAAAAACCTCATGTGTAATAGGCGTATAATGTATAACAGGTGACCAA
TGTTTTCTGAATGCATAAAGAAATGAATAAACTCAAACACAGTACTTCCTAAACAACTTC
AACCAAAAAGACCAAAACATGGAACGAATGGAAGCTTGTAAGGACATGCTTGTTTTAGT
CCAGTGGTTTCCACAGCTGGCTAAGCCAGGAGTCACTTGGAGGCTTTTAAATACAAAACA
TTGGAGCTGGAGGCCATTATCCTTAGCAAACTAATGCAGAAACAGAAATCAACTACCGC
ATGTTCTCACTTATAAGTGGGAGGTAATGATAAGAACTTATGAACACAAAGAAGGAAACA
ATAGACATTGGAGTCTATTTGAGAGGGGAGGGTGGGAGAAGGAAAAGGAGCAGAAAAGAT
AACTATTGAGTACTGCCTTCACACCTGGGTGATGAAATAATATGTACAACAAATCCCTGT
GACACATGTTTACCTATGGAACAAACCTTCATGTGTATCCCTAAACCTAAAATAAAGTT
AAAAAAAAAAAARAAAAAAAAAAAAAAAAAAAAAAAAAAAAAAAAAAAAAAAAAAAAAA
AAAAAAAAAAAAAAAAAAAAAAAAAAAAAAAAAAAAAAAAAAAAAAAAAAAAAAAAAAA
```

FIGURE 280

MALLLCFVLLCGVVDFARSLSITTPEEMIEKAKGETAYLPCKFTLSPEDQGPLDIEWLIS
PADNQKVDQVIILYSGDKIYDDYYPDLKGRVHFTSNDLKSGDASINVTNLQLSDIGTYQC
KVKKAPGVANKKIHLVVLVKPSGARCYVDGSEEIGSDFKIKCEPKEGSLPLQYEWQKLSD
SQKMPTSWLAEMTSSVISVKNASSEYSGTYSCTVRNRVGSDQCLLRLNVVPPSNKAGLIA
GAIIGTLLALALIGLIIFCCRKKRREEKYEKEVHHDIREDVPPPKSRTSTARSYIGSNHS
SLGSMSPSNMEGYSKTQYNQVPSEDFERTPQSPTLPPAKFKYPYKTDGITVV

Signal sequence.
amino acids 1-19

Transmembrane domain:
amino acids 236-257

N-glycosylation sites:
amino acids 106-110, 201-205, 298-302

Tyrosine kinase phosphorylation sites:
amino acids 31-39, 78-85, 262-270

N-myristoylation sites:
amino acids 116-122, 208-214, 219-225, 237-243, 241-247, 245-251, 296-302

Myelin P0 protein:
amino acids 96-125

FIGURE 281

TGCATCAGTGCCCAGGCAAGCCCAGGAGTTGACATTTCTCTGCCCAGCCATGGGCCTCAC
CCTGCTCTTGCTGCTGCTCCTGGGACTAGAAGGTCAGGGCATAGTTGGCAGCCTCCCTGA
GGTGCTGCAGGCACCCGTGGGAAGCTCCATTCTGGTGCAGTGCCACTACAGGCTCCAGGA
TGTCAAAGCTCAGAAGGTGTGGTGCCGGTTCTTGCCGGAGGGGTGCCAGCCCCTGGTGTC
CTCAGCTGTGGATCGCAGAGCTCCAGCGGGCAGGCGTACGTTTCTCACAGACCTGGGTGG
GGGCCTGCTGCAGGTGGAAATGGTTACCCTGCAGGAAGAGGATGCTGGCGAGTATGGCTG
CATGGTGGATGGGGCCAGGGGGCCCCAGATTTTGCACAGAGTCTCTCTGAACATACTGCC
CCCAGAGGAAGAAGAAGAGACCCATAAGATTGGCAGTCTGGCTGAGAACGCATTCTCAGA
CCCTGCAGGCAGTGCCAACCCTTTGGAACCCAGCCAGGATGAGAAGAGCATCCCCTTGAT
CTGGGGTGCTGTGCTCCTGGTAGGTCTGCTGGTGGCAGCGGTGGTGCTGTTTGCTGTGAT
GGCCAAGAGGAAACAAGAATCCCTCCTCAGTGGTCCACCACGTCAGTGACTCTGGACCGG
CTGCTGAATTGCCTTTGGATGTACCACACATTAGGCTTGACTCACCACCTTCATTTGACA
ATACCACCTACACCAGCCTACCTCTTGATTCCCCATCAGGAAAACCTTCACTCCCAGCTC
CATCCTCATTGCCCCCTCTACCTCCTAAGGTCCTGGTCTGCTCCAAGCCTGTGACATATG
CCACAGTAATCTTCCCGGGAGGGAACAAGGGTGGAGGGACCTCGTGTGGGCCAGCCCAGA
ATCCACCTAACAATCAGACTCCATCCAGCTAAGCTGCTCATCACACTTTAAACTCATGAG
GACCATCCCTAGGGGTTCTGTGCATCCATCCAGCCAGCTCATGCCCTAGGATCCTTAGGA
TATCTGAGCAACCAGGGACTTTAAGATCTAATCCAATGTCCTAACTTTACTAGGGAAAGT
GACGCTCAGACATGACTGAGATGTCTTGGGGAAGACCTCCCTGCACCCAACTCCCCCACT
GGTTCTTCTACCATTACACACTGGGCTAAATAAACCCTAATAATGATGTGCAAAAAAAAA
AAAAAAAAAAAAAAAAAAAAAAAAAAAAAAAAAAAAA

FIGURE 282

MGLTLLLLLLLGLEGQGIVGSLPEVLQAPVGSSILVQCHYRLQDVKAQKVWCRFLPEGCQ
PLVSSAVDRRAPAGRRTFLTDLGGGLLQVEMVTLQEEDAGEYGCMVDGARGPQILHRVSL
NILPPEEEEETHKIGSLAENAFSDPAGSANPLEPSQDEKSIPLIWGAVLLVGLLVAAVVL
FAVMAKRKQESLLSGPPRQ

Important features of the protein:
Signal peptide:
amino acids 1-15

Transmembrane domain:
amino acids 161-181

N-myristoylation sites:
amino acids 17-23, 172-178

Amidation site:
amino acids 73-79

FIGURE 283

GTAGCATAGTGTGCAGTTCACTGGACCAAAAGCTTTGGCTGCACCTCTTCTGGAAAGCTG
GCCATGGGGCTCTTCATGATCATTGCAATTCTGCTGTTCCAGAAACCCACAGTAACCGAA
CAACTTAAGAAGTGCTGGAATAACTATGTACAAGGACATTGCAGGAAAATCTGCAGAGTA
AATGAAGTGCCTGAGGCACTATGTGAAAATGGGAGATACTGTTGCCTCAATATCAAGGAA
CTGGAAGCATGTAAAAAAATTACAAAGCCACCTCGTCCAAAGCCAGCAACACTTGCACTG
ACTCTTCAAGACTATGTTACAATAATAGAAAATTTCCCAAGCCTGAAGACACAGTCTACA
TAAATCAAATACAATTTCGTTTTCACTTGCTTCTCAACCTAGTCTAATAAACTAAGGTGA
TGAGATATACATCTTCTTCCTTCTGGTTTCTTGATCCTTAAAATGACCTTCGAGCATATT
CTAATAAAGTGCATTGCCAGTTAAAAAAAAAAA

FIGURE 284

MGLFMIIAILLFQKPTVTEQLKKCWNNYVQGHCRKICRVNEVPEALCENGRYCCLNIKEL
EACKKITKPPRPKPATLALTLQDYVTIIENFPSLKTQST

Important features of the protein:

Signal peptide:
None

Transmembrane domain:
None cAMP- and cGMP-dependent protein kinase phosphorylation site:
64-68

FIGURE 285

```
GATGGCGCAGCCACAGCTTCTGTGAGATTCGATTTCTCCCCAGTTCCCCTGTGGGTCTGA
GGGGACCAGAAGGGTGAGCTACGTTGGCTTTCTGGAAGGGGAGGCTATATGCGTCAATTC
CCCAAAACAAGTTTTGACATTTCCCCTGAAATGTCATTCTCTATCTATTCACTGCAAGTG
CCTGCTGTTCCAGGCCTTACCTGCTGGGCACTAACGGCGGAGCCAGGATGGGGACAGAAT
AAAGGAGCCACGACCTGTGCCACCAACTCGCACTCAGACTCTGAACTCAGACCTGAAATC
TTCTCTTCACGGGAGGCTTGGCAGTTTTTCTTACTCCTGTGGTCTCCAGATTTCAGGCCT
AAGATGAAAGCCTCTAGTCTTGCCTTCAGCCTTCTCTCTGCTGCGTTTTATCTCCTATGG
ACTCCTTCCACTGGACTGAAGACACTCAATTTGGGAAGCTGTGTGATCGCCACAAACCTT
CAGGAAATACGAAATGGATTTTCTGAGATACGGGGCAGTGTGCAAGCCAAAGATGGAAAC
ATTGACATCAGAATCTTAAGGAGGACTGAGTCTTTGCAAGACACAAAGCCTGCGAATCGA
TGCTGCCTCCTGCGCCATTTGCTAAGACTCTATCTGGACAGGGTATTTAAAAACTACCAG
ACCCCTGACCATTATACTCTCCGGAAGATCAGCAGCCTCGCCAATTCCTTTCTTACCATC
AAGAAGGACCTCCGGCTCTCTCATGCCCACATGACATGCCATTGTGGGGAGGAAGCAATG
AAGAAATACAGCCAGATTCTGAGTCACTTTGAAAAGCTGGAACCTCAGGCAGCAGTTGTG
AAGGCTTTGGGGGAACTAGACATTCTTCTGCAATGGATGGAGGAGACAGAATAGGAGGAA
AGTGATGCTGCTGCTAAGAATATTCGAGGTCAAGAGCTCCAGTCTTCAATACCTGCAGAG
GAGGCATGACCCCAAACCACCATCTCTTTACTGTACTAGTCTTGTGCTGGTCACAGTGTA
TCTTATTTATGCATTACTTGCTTCCTTGCATGATTGTCTTTATGCATCCCCAATCTTAAT
TGAGACCATACTTGTATAAGATTTTGTAATATCTTTCTGCTATTGGATATATTTATTAG
TTAATATATTTATTTATTTTTGCTATTTAATGTATTTATTTTTTACTTGGACATGAAA
CTTTAAAAAAATTCACAGATTATATTTATAACCTGACTAGAGCAGGTGATGTATTTTTAT
ACAGTAAAAAAAAAAAACCTTGTAAATTCTAGAAGAGTGGCTAGGGGGGTTATTCATTTG
TATTCAACTAAGGACATATTTACTCATGCTGATGCTCTGTGAGATATTTGAAATTGAACC
AATGACTACTTAGGATGGGTTGTGGAATAAGTTTTGATGTGGAATTGCACATCTACCTTA
CAATTACTGACCATCCCCAGTAGACTCCCCAGTCCCATAATTGTGTATCTTCCAGCCAGG
AATCCTACACGGCCAGCATGTATTTCTACAAATAAAGTTTTCTTTGCATACCAAAAAAAA
AAAAAAAAAA
```

FIGURE 286

MKASSLAFSLLSAAFYLLWTPSTGLKTLNLGSCVIATNLQEIRNGFSEIRGSVQAKDGNI
DIRILRRTESLQDTKPANRCCLLRHLLRLYLDRVFKNYQTPDHYTLRKISSLANSFLTIK
KDLRLSHAHMTCHCGEEAMKKYSQILSHFEKLEPQAAVVKALGELDILLQWMEETE

FIGURE 287

```
AATGCCCCATGCGCACCCCACAGCTCGCGCTCCTGCAAGTGTTCTTTCTGGTGTTCCCCG
ATGGCGTCCGGCCTCAGCCCTCTTCCTCCCCATCAGGGGCAGTGCCCACGTCTTTGGAGC
TGCAGCGAGGGACGGATGGCGGAACCCTCCAGTCCCCTTCAGAGGCGACTGCAACTCGCC
CGGCCGTGCCTGGACTCCCTACAGTGGTCCCTACTCTCGTGACTCCCTCGGCCCTGGGA
ATAGGACTGTGGACCTCTTCCCAGTCTTACCGATCTGTGTCTGTGACTTGACTCCTGGAG
CCTGCGATATAAATTGCTGCTGCGACAGGGACTGCTATCTTCTCCATCCGAGGACAGTTT
TCTCCTTCTGCCTTCCAGGCAGCGTAAGGTCTTCAAGCTGGGTTTGTGTAGACAACTCTG
TTATCTTCAGGAGTAATTCCCCGTTTCCTTCAAGAGTTTTCATGGATTCTAATGGAATCA
GGCAGTTTTGTGTCCATGTGAACAACTCAAACTTAAACTATTTCCAGAAGCTTCAAAAGG
TCAATGCAACCAACTTCCAGGCCCTGGCTGCAGAGTTTGGAGGCGAATCATTCACTTCAA
CATTCCAAACTCAATCACCACCATCTTTTTACAGGGCTGGGGACCCCATTCTTACTTACT
TCCCCAAGTGGTCTGTAATAAGCTTGCTGAGACAACCTGCAGGAGTTGGAGCTGGGGAC
TCTGTGCTGAAAGCAATCCTGCAGGTTTCCTAGAGAGTAAAAGTACAACTTGCACTCGTT
TTTTCAAGAACCTGGCTAGTAGCTGTACCTTGGATTCAGCCCTCAATGCTGCCTCTTACT
ATAACTTCACAGTCTTAAAGGTTCCAAGAAGCATGACTGATCCACAGAATATGGAGTTCC
AGGTTCCTGTAATACTTACCTCACAGGCTAATGCTCCTCTGTTGGCTGGAAACACTTGTC
AGAATGTAGTTTCTCAGGTCACCTATGAGATAGAGACCAATGGGACTTTTGGAATCCAGA
AAGTTTCTGTCAGTTTGGGACAAACCAACCTGACTGTTGAGCCAGGCGCTTCCTTACAGC
AACACTTCATCCTTCGCTTCAGGGCTTTTCAACAGAGCACAGCTGCTTCTCTCACCAGTC
CTAGAAGTGGGAATCCTGGCTATATAGTTGGGAAGCCACTCTTGGCTCTGACTGATGATA
TAAGTTACTCAATGACCCTCTTACAGAGCCAGGGTAATGGAAGTTGCTCTGTTAAAAGAC
ATGAAGTGCAGTTTGGAGTGAATGCAATATCTGGATGCAAGCTCAGGTTGAAGAAGGCAG
ACTGCAGCCACTTGCAGCAGGAGATTTATCAGACTCTTCATGGAAGGCCCAGACCAGAGT
ATGTTGCCATCTTTGGTAATGCTGACCCAGCCCAGAAAGGAGGGTGGACCAGGATCCTCA
ACAGGCACTGCAGCATTTCAGCTATAAACTGTACTTCCTGCTGTCTCATACCAGTTTCCC
TGGAGATCCAGGTATTGTGGGCATATGTAGGTCTCCTGTCCAACCCGCAAGCTCATGTAT
CAGGAGTTCGATTCCTATACCAGTGCCAGTCTATACAGGATTCTCAGCAAGTTACAGAAG
TATCTTTGACAACTCTTGTGAACTTTGTGGACATTACCCAGAAGCCACAGCCTCCAAGGG
GCCAACCCAAAATGGACTGGAAATGGCCATTCGACTTCTTTCCCTTCAAAGTGGCATTCA
GCAGAGGAGTATTCTCTCAAAAATGCTCAGTCTCTCCATCCTTATCCTGTGCCTCTTAC
TACTTGGAGTTCTCAACCTAGAGACTATGTGAAGAAAAGAAAATAATCAGATTTCAGTTT
TCCCTATGAGAAACTCTGAGGCAGCCACTTATCTTGGCTAAATAGAACCTCACCTGCTCA
TGACCAGAGAGCATTTAGGATAATAGATGACCTAACTGAAGGAATCCTTGTATATGAAAG
GAGTTATTTTAGAAAAGCAATAAAAATATTTTATTCATCNTAAAAAAAAAA
```

FIGURE 288

```
MRTPQLALLQVFFLVFPDGVRPQPSSSPSGAVPTSLELQRGTDGGTLQSPSEATATRPAV
PGLPTVVPTLVTPSAPGNRTVDLFPVLPICVCDLTPGACDINCCCDRDCYLLHPRTVFSF
CLPGSVRSSSWVCVDNSVIFRSNSPFPSRVFMDSNGIRQFCVHVNNSNLNYFQKLQKVNA
TNFQALAAEFGGESFTSTFQTQSPPSFYRAGDPILTYFPKWSVISLLRQPAGVGAGGLCA
ESNPAGFLESKSTTCTRFFKNLASSCTLDSALNAASYYNFTVLKVPRSMTDPQNMEFQVP
VILTSQANAPLLAGNTCQNVVSQVTYEIETNGTFGIQKVSVSLGQTNLTVEPGASLQQHF
ILRFRAFQQSTAASLTSPRSGNPGYIVGKPLLALTDDISYSMTLLQSQGNGSCSVKRHEV
QFGVNAISGCKLRLKKADCSHLQQEIYQTLHGRPRPEYVAIFGNADPAQKGGWTRILNRH
CSISAINCTSCCLIPVSLEIQVLWAYVGLLSNPQAHVSGVRFLYQCQSIQDSQQVTEVSL
TTLVNFVDITQKPQPPRGQPKMDWKWPFDFFPFKVAFSRGVFSQKCSVSPILILCLLLLG
VLNLETM
```

Important features of the protein:
Signal peptide:
amino acids 1-22

Transmembrane domains:
amino acids 484-505, 581-600

N-glycosylation sites:
amino acids 78-82, 165-169, 179-185, 279-285, 331-337, 347-351, 410-414, 487-491

N-myristoylation sites:
amino acids 30-36, 41-47, 124-130, 232-238, 236-242, 409-415

Prokaryotic membrane lipoprotein lipid attachment site:
amino acids 420-431

FIGURE 289

```
CGCGGAGCCCTGCGCTGGGAGGTGCACGGTGTGCACGCTGGACTGGACCCCATGCAACC
CCGCGCCCTGCGCCTTAACCAGGACTGCTCCGCGCGCCCTGAGCCTCGGGCTCCGGCCC
GGACCTGCAGCCTCCCAGGTGGCTGGGAAGAACTCTCCAACAATAAATACATTTGATAAG
AAAGATGGCTTTAAAAGTGCTACTAGAACAAGAGAAAACGTTTTTCACTCTTTTAGTATT
ACTAGGCTATTTGTCATGTAAAGTGACTTGTGAATCAGGAGACTGTAGACAGCAAGAATT
CAGGGATCGGTCTGGAAACTGTGTTCCCTGCAACCAGTGTGGGCCAGGCATGGAGTTGTC
TAAGGAATGTGGCTTCGGCTATGGGGAGGATGCACAGTGTGTGACGTGCCGGCTGCACAG
GTTCAAGGAGGACTGGGGCTTCCAGAAATGCAAGCCCTGTCTGGACTGCGCAGTGGTGAA
CCGCTTTCAGAAGGCAAATTGTTCAGCCACCAGTGATGCCATCTGCGGGACTGCTTGCC
AGGATTTTATAGGAAGACGAAACTTGTCGGCTTTCAAGACATGGAGTGTGTGCCTTGTGG
AGACCCTCCTCCTCCTTACGAACCGCACTGTGCCAGCAAGGTCAACCTCGTGAAGATCGC
GTCCACGGCCTCCAGCCCACGGGACACGGCGCTGGCTGCCGTTATCTGCAGCGCTCTGGC
CACCGTCCTGCTGGCCCTGCTCATCCTCTGTGTCATCTATTGTAAGAGACAGTTTATGGA
GAAGAAACCCAGCTGGTCTCTGCGGTCGCAGGACATTCAGTACAACGGCTCTGAGCTGTC
GTGTTTTGACAGACCTCAGCTCCACGAATATGCCCACAGAGCCTGCTGCCAGTGCCGCCG
TGACTCAGTGCAGACCTGCGGGCCGGTGCGCTTGCTCCCATCCATGTGCTGTGAGGAGGC
CTGCAGCCCCAACCCGGCGACTCTTGGTTGTGGGGTGCATTCTGCAGCCAGTCTTCAGGC
AAGAAACGCAGGCCCAGCCGGGGAGATGGTGCCGACTTTCTTCGGATCCCTCACGCAGTC
CATCTGTGGCGAGTTTTCAGATGCCTGGCCTCTGATGCAGAATCCCATGGGTGGTGACAA
CATCTCTTTTTGTGACTCTTATCCTGAACTCACTGGAGAAGACATTCATTCTCTCAATCC
AGAACTTGAAAGCTCAACGTCTTTGGATTCAAATAGCAGTCAAGATTTGGTTGGTGGGC
TGTTCCAGTCCAGTCTCATTCTGAAAACTTTACAGCAGCTACTGATTTATCTAGATATAA
CAACACACTGGTAGAATCAGCATCAACTCAGGATGCACTAACTATGAGAAGCCAGCTAGA
TCAGGAGAGTGGCGCTGTCATCCACCCAGCCACTCAGACGTCCCTCCAGGAAGCTTAAAG
AACCTGCTTCTTTCTGCAGTAGAAGCGTGTGCTGGAACCCAAAGAGTACTCCTTTGTTAG
GCTTATGGACTGAGCAGTCTGGACCTTGCATGGCTTCTGGGGCAAAAATAAATCTGAACC
AAACTGACGGCATTTGAAGCCTTTCAGCCAGTTGCTTCTGAGCCAGACCAGCTGTAAGCT
GAAACCTCAATGAATAACAAGAAAAGACTCCAGGCCGACTCATGATACTCTGCATCTTTC
CTACATGAGAAGCTTCTCTGCCACAAAGTGACTTCAAAGACTGATGGGTTGAGCTGGCA
GCCTATGAGATTGTGGACATATAACAAGAAACAGAAATGCCCTCATGCTTATTTTCATGG
TGATTGTGGTTTTACAAGACTGAAGACCCAGAGTATACTTTTCTTTCCAGAAATAATTT
CATACCGCCTATGAAATATCAGATAAATTACCTTAGCTTTTATGTAGAATGGGTTCAAAA
GTGAGTGTTTCTATTTGAGAAGGACACTTTTTCATCATCTAAACTGATTCGCATAGGTGG
TTAGAATGGCCCTCATATTGCCTGCCTAAATCTTGGGTTTATTAGATGAAGTTTACTGAA
TCAGAGGAATCAGACAGAGGAGGATAGCTCTTTCCAGAATCCACACTTCTGACCTCAGCC
TCGGTCTCATGAACACCCGCTGATCTCAGGAGAACACCTGGGCTAGGGAATGTGGTCGAG
AAAGGGCAGCCCATTGCCCAGAATTAACACATATTGTAGAGACTTGTATGCAAAGGTTGG
CATATTTATATGAAAATTAGTTGCTATAGAAACATTTGTTGCATCTGTCCCTCTGCCTGA
GCTTAGAAGGTTATAGAAAAGGGTATTTATAAACATAAATGACCTTTTACTTGCATTGT
ATCTTATACTAAAGGCTTTAGAAATTACAACATATCAGGTTCCCCTACTACTGAAGTAGC
CTTCCGTGAGAACACACCACATGTTAGGACTAGAAGAAATGCACAATTTGTAGGGGTTT
GGATGAAGCAGCTGTAACTGCCCTAGTGTAGTTTGACCAGGACATTGTCGTGCTCCTTCC
AATTGTGTAAGATTAGTTAGCACATCATCTCCTACTTTAGCCATCCGGTGTTGGATTTAA
GAGGACGGTGCTTCTTTCTATTAAAGTGCTCCATCCCCTACCATCTACACATTAGCATTG
TCTCTAGAGCTAAGACAGAAATTAACCCCGTTCAGTCACAAAGCAGGGAATGGTTCATTT
ACTCTTAATCTTTATGCCCTGGAGAAGACCTACTTGAACAGGGCATATTTTTAGACTTC
TGAACATCAGTATGTTCGAGGGTACTATGATATTTGGTTTGGAATTGCCCTGCCCAAGT
CACTGTCTTTTAACTTTTAAACTGAATATTAAAATGTATCTGTCTTTCCT
```

FIGURE 290

```
MALKVLLEQEKTFFTLLVLLGYLSCKVTCESGDCRQQEFRDRSGNCVPCNQCGPGMELSK
ECGFGYGEDAQCVTCRLHRFKEDWGFQKCKPCLDCAVVNRFQKANCSATSDAICGDCLPG
FYRKTKLVGFQDMECVPCGDPPPPYEPHCASKVNLVKIASTASSPRDTALAAVICSALAT
VLLALLILCVIYCKRQFMEKKPSWSLRSQDIQYNGSELSCFDRPQLHEYAHRACCQCRRD
SVQTCGPVRLLPSMCCEEACSPNPATLGCGVHSAASLQARNAGPAGEMVPTFFGSLTQSI
CGEFSDAWPLMQNPMGGDNISFCDSYPELTGEDIHSLNPELESSTSLDSNSSQDLVGGAV
PVQSHSENFTAATDLSRYNNTLVESASTQDALTMRSQLDQESGAVIHPATQTSLQEA
```

Important features of the protein:
Signal peptide:
Amino acids 1-25

Transmembrane domain:
Amino acids 169-192

N-glycosylation sites:
Amino acids 105-109; 214-218; 319-323; 350-354; 368-372; 379-383 cAMP- and cGMP-dependent protein kinase phosphorylation sites:
Amino acids 200-204; 238-242

Tyrosine kinase phosphorylation site:
Amino acids 207-214

N-myristoylation sites:
Amino acids 55-61; 215-221; 270-276

Prokaryotic membrane lipoprotein lipid attachment site:
Amino acids 259-270

TNFR/NGFR family cysteine-rich region proteins:
Amino acids 89-96

FIGURE 291

```
CCTGGAGCCGGAAGCGCGGCTGCAGCAGGGCGAGGCTCCAGGTGGGGTCGGTTCCGCATC
CAGCCTAGCGTGTCCACGATGCGGCTGGGCTCCGGGACTTTCGCTACCTGTTGCGTAGCG
ATCGAGGTGCTAGGGATCGCGGTCTTCCTTCGGGGATTCTTCCCGGCTCCCGTTCGTTCC
TCTGCCAGAGCGGAACACGGAGCGGAGCCCCCAGCGCCCGAACCCTCGGCTGGAGCCAGT
TCTAACTGGACCACGCTGCCACCACCTCTCTTCAGTAAAGTTGTTATTGTTCTGATAGAT
GCCTTGAGAGATGATTTTGTGTTTGGGTCAAAGGGTGTGAAATTTATGCCCTACACAACT
TACCTTGTGGAAAAAGGAGCATCTCACAGTTTTGTGGCTGAAGCAAAGCCACCTACAGTT
ACTATGCCTCGAATCAAGGCATTGATGACGGGGAGCCTTCCTGGCTTTGTCGACGTCATC
AGGAACCTCAATTCTCCTGCACTGCTGGAAGACAGTGTGATAAGACAAGCAAAAGCAGCT
GGAAAAAGAATAGTCTTTTATGGAGATGAAACCTGGGTTAAATTATTCCCAAAGCATTTT
GTGGAATATGATGGAACAACCTCATTTTTCGTGTCAGATTACACAGAGGTGGATAATAAT
GTCACGAGGCATTTGGATAAAGTATTAAAAAGAGGAGATTGGGACATATTAATCCTCCAC
TACCTGGGGCTGGACCACATTGGCCACATTTCAGGGCCCAACAGCCCCTGATTGGGCAG
AAGCTGAGCGAGATGGACAGCGTGCTGATGAAGATCCACACCTCACTGCAGTCGAAGGAG
AGAGAGACGCCTTTACCCAATTTGCTGGTTCTTTGTGGTGACCATGGCATGTCTGAAACA
GGAAGTCACGGGCCTCCTCCACCGAGGAGGTGAATACACCTCTGATTTAATCAGTTCT
GCGTTTGAAAGGAAACCCGGTGATATCCGACATCCAAAGCACGTCCAATAGACGGATGTG
GCTGCGACACTGGCGATAGCACTTGGCTTACCGATTCCAAAAGACAGTGTAGGGAGCCTC
CTATTCCCAGTTGTGGAAGGAAGACCAATGAGAGAGCAGTTGAGATTTTTACATTTGAAT
ACAGTGCAGCTTAGTAAACTGTTGCAAGAGAATGTGCCGTCATATGAAAAGATCCTGGG
TTTGAGCAGTTTAAAATGTCAGAAAGATTGCATGGGAACTGGATCAGACTGTACTTGGAG
GAAAAGCATTCAGAAGTCCTATTCAACCTGGGCTCCAAGGTTCTCAGGCAGTACCTGGAT
GCTCTGAAGACGCTGAGCTTGTCCCTGAGTGCACAAGTGGCCCAGTTCTCACCCTGCTCC
TGCTCAGCGTCCCACAGGCACTGCACAGAAAGGCTGAGCTGGAAGTCCCACTGTCATCTC
CTGGGTTTTCTCTGCTCTTTTATTTGGTGATCCTGGTTCTTTCGGCCGTTCACGTCATTG
TGTGCACCTCAGCTGAAAGTTCGTGCTACTTCTGTGGCCTCTCGTGGCTGGCGGCAGGCT
GCCTTTCGTTTACCAGACTCTGGTTGAACACCTGGTGTGTGCCAAGTGCTGGCAGTGCCC
TGGACAGGGGGCCTCAGGGAAGGACGTGGAGCAGCCTTATCCCAGGCCTCTGGGTGTCCC
GACACAGGTGTTCACATCTGTGCTGTCAGGTCAGATGCCTCAGTTCTTGGAAAGCTAGGT
TCCTGCGACTGTTACCAAGGTGATTGTAAAGAGCTGGCGGTCACAGAGGAACAAGCCCCC
CAGCTGAGGGGGTGTGTGAATCGGACAGCCTCCCAGCAGAGGTGTGGGAGCTGCAGCTGA
GGGAAGAAGAGACAATCGGCCTGGACACTCAGGAGGGTCAAAAGGAGACTTGGTCGCACC
ACTCATCCTGCCACCCCAGAATGCATCCTGCCTCATCAGGTCCAGATTTCTTTCCAAGG
CGGACGTTTTCTGTTGGAATTCTTAGTCCTTGGCCTCGGACACCTTCATTCGTTAGCTGG
GGAGTGGTGGTGAGGCAGTGAAGAAGAGGCGGATGGTCACACTCAGATCCACAGAGCCCA
GGATCAAGGGACCCACTGCAGTGGCAGCAGGACTGTTGGGCCCCACCCCAACCCTGCAC
AGCCCTCATCCCCTCTTGGCTTGAGCCGTCAGAGGCCCTGTGCTGAGTGTCTGACCGAGA
CACTCACAGCTTTGTCATCAGGGCACAGGCTTCCTCGGAGCCAGGATGATCTGTGCCACG
CTTGCACCTCGGGCCCATCTGGGCTCATGCTCTCTCTCCTGCTATTGAATTAGTACCTAG
CTGCACACAGTATGTAGTTACCAAAAGAATAAACGGCAATAATTGAGAAAAAAA
```

FIGURE 292

MRLGSGTFATCCVAIEVLGIAVFLRGFFPAPVRSSARAEHGAEPPAPEPSAGASSNWTTL
PPPLFSKVVIVLIDALRDDFVFGSKGVKFMPYTTYLVEKGASHSFVAEAKPPTVTMPRIK
ALMTGSLPGFVDVIRNLNSPALLEDSVIRQAKAAGKRIVFYGDETWVKLFPKHFVEYDGT
TSFFVSDYTEVDNNVTRHLDKVLKRGDWDILILHYLGLDHIGHISGPNSPLIGQKLSEMD
SVLMKIHTSLQSKERETPLPNLLVLCGDHGMSETGSHGASSTEEVNTPLILISSAFERKP
GDIRHPKHVQ

Important features of the protein:
Signal peptide:
amino acids 1-34

Transmembrane domain:
amino acids 58-76

N-glycosylation sites:
amino acids 56-60, 194-198

N-myristoylation sites:
amino acids 6-12, 52-58, 100-106, 125-131, 233-239, 270-276, 275-281, 278-284

Amidation site:
amino acids 154-158

Cell attachment sequence:
amino acids 205-208

FIGURE 293

AGCCAGGCAGCACATCACAGCGGGAGGAGCTGTCCCAGGTGGCCCAGCTCAGCAATGGCA
ATGGGGGTCCCCAGAGTCATTCTGCTCTGCCTCTTTGGGGCTGCGCTCTGCCTGACAGGG
TCCCAAGCCCTGCAGTGCTACAGCTTTGAGCACACCTACTTTGGCCCCTTTGACCTCAGG
GCCATGAAGCTGCCCAGCATCTCCTGTCCTCATGAGTGCTTTGAGGCTATCCTGTCTCTG
GACACCGGGTATCGCGCGCCGGTGACCCTGGTGCGGAAGGGCTGCTGGACCGGGCCTCCT
GCGGGCCAGACGCAATCGAACCCGGACGCGCTGCCGCCAGACTACTCGGTGGTGCGCGGC
TGCACAACTGACAAATGCAACGCCCACCTCATGACTCATGACGCCCTCCCCAACCTGAGC
CAAGCACCCGACCCGCCGACGCTCAGCGGCGCCGAGTGCTACGCCTGTATCGGGGTCCAC
CAGGATGACTGCGCTATCGGCAGGTCCCGACGAGTCCAGTGTCACCAGGACCAGACCGCC
TGCTTCCAGGGCAGTGGCAGAATGACAGTTGGCAATTTCTCAGTCCCTGTGTACATCAGA
ACCTGCCACCGGCCCTCCTGCACCACCGAGGGCACCACCAGCCCCTGGACAGCCATCGAC
CTCCAGGGCTCCTGCTGTGAGGGGTACCTCTGCAACAGGAAATCCATGACCCAGCCCTTC
ACCAGTGCTTCAGCCACCACCCCTCCCCGAGCACTACAGGTCCTGGCCCTGCTCCTCCCA
GTCCTCCTGCTGGTGGGGCTCTCAGCATAGACCGCCCCTCCAGGATGCTGGGGACAGGGC
TCACACACCTCATTCTTGCTGCTTCAGCCCCTATCACATAGCTCACTGGAAAATGATGTT
AAAGTAAGAATTGCAAAA

FIGURE 294

MAMGVPRVILLCLFGAALCLTGSQALQCYSFEHTYFGPFDLRAMKLPSISCPHECFEAIL
SLDTGYRAPVTLVRKGCWTGPPAGQTQSNPDALPPDYSVVRGCTTDKCNAHLMTHDALPN
LSQAPDPPTLSGAECYACIGVHQDDCAIGRSRRVQCHQDQTACFQGSGRMTVGNFSVPVY
IRTCHRPSCTTEGTTSPWTAIDLQGSCCEGYLCNRKSMTQPFTSASATTPPRALQVLALL
LPVLLLVGLSA

Important features of the protein:
Signal peptide:
amino acids 1-19

Transmembrane domain:
amino acids 233-251

N-glycosylation sites:
amino acids 120-124, 174-178

N-myristoylation sites:
amino acids 15-21, 84-90

FIGURE 295

AATCGGCTGATTCTGCATCTGGAAACTGCCTTCATCTTGAAAGAAAAGCTCCAGGTCCCT
TCTCCAGCCACCCAGCCCCAAGATGGTGATGCTGCTGCTGCTGCTTTCCGCACTGGCTGG
CCTCTTCGGTGCGGCAGAGGGACAAGCATTTCATCTTGGGAAGTGCCCCAATCCTCCGGT
GCAGGAGAATTTTGACGTGAATAAGTATCTCGGAAGATGGTACGAAATTGAGAAGATCCC
AACAACCTTTGAGAATGGACGCTGCATCCAGGCCAACTACTCACTAATGGAAAACGGAAA
GATCAAAGTGTTAAACCAGGAGTTGAGAGCTGATGGAACTGTGAATCAAATCGAAGGTGA
AGCCACCCAGTTAACCTCACAGAGCCTGCCAAGCTGGAAGTTAAGTTTTCCTGGTTTAT
GCCATCGGCACCGTACTGGATCCTGGCCACCGACTATGAGAACTATGCCCTCGTGTATTC
CTGTACCTGCATCATCCAACTTTTTCACGTGGATTTTGCTTGGATCTTGGCAAGAAACCC
TAATCTCCCTCCAGAAACAGTGGACTCTCTAAAAAATATCCTGACTTCTAATAACATTGA
TGTCAAGAAAATGACGGTCACAGACCAGGTGAACTGCCCCAAGCTCTCGTAACCAGGTTC
TACAGGGAGGCTGCACCCACTCCATGTTACTTCTGCTTCGCTTTCCCCTACCCCACCCCC
CCCCCATAAAGACAAACCAATCAACCACGACAAAGGAAGTTGACCTGAACATGTAACCAT
GCCCTACCCTGTTACCTTGCTAGCTGCAAAATAAACTTGTTGCTGACCTGCTGTGCTCGC
AAAAAA

FIGURE 296

MVMLLLLLSALAGLFGAAEGQAFHLGKCPNPPVQENFDVNKYLGRWYEIEKIPTTFENG
RCIQANYSLMENGKIKVLNQELRADGTVNQIEGEATPVNLTEPAKLEVKFSWFMPSAPY
WILATDYENYALVYSCTCIIQLFHVDFAWILARNPNLPPETVDSLKNILTSNNIDVKKM
TVTDQVNCPKLS

Signal sequence:
1-16

N-glycosylation site:
65-68
98-101 cAMP- and cGMP-dependent protein kinase phosphorylation site:
175-178

N-myristoylation site:
13-18
16-21

Lipocalin proteins:
36-47
120-130

Lipocalin / cytosolic fatty-acid binding proteins:
41-185

FIGURE 297

GGGTGATTGAACTAAACCTTCGCCGCACCGAGTTTGCAGTACGGCCGTCACCCGCACCGC
TGCCTGCTTGCGGTTGGAGAAATCAAGGCCCTACCGGGCCTCCGTAGTCACCTCTCTATA
GTGGGCGTGGCCGAGGCCGGGGTGACCCTGCCGGAGCCTCCGCTGCCAGCGACATGTTCA
AGGTAATTCAGAGGTCCGTGGGGCCAGCCAGCCTGAGCTTGCTCACCTTCAAAGTCTATG
CAGCACCAAAAAAGGACTCACCTCCCAAAAATTCCGTGAAGGTTGATGAGCTTTCACTCT
ACTCAGTTCCTGAGGGTCAATCGAAGTATGTGGAGGAGGCAAGGAGCCAGCTTGAAGAAA
GCATCTCACAGCTCCGACACTATTGCGAGCCATACACAACCTGGTGTCAGGAAACGTACT
CCCAAACTAAGCCCAAGATGCAAAGTTTGGTTCAATGGGGGTTAGACAGCTATGACTATC
TCCAAAATGCACCTCCTGGATTTTTTCCGAGACTTGGTGTTATTGGTTTTGCTGGCCTTA
TTGGACTCCTTTTGGCTAGAGGTTCAAAAATAAAGAAGCTAGTGTATCCGCCTGGTTTCA
TGGGATTAGCTGCCTCCCTCTATTATCCACAACAAGCCATCGTGTTTGCCCAGGTCAGTG
GGGAGAGATTATATGACTGGGGTTTACGAGGATATATAGTCATAGAAGATTTGTGGAAGG
AGAACTTTCAAAAGCCAGGAAATGTGAAGAATTCACCTGGAACTAAGTAGAAAACTCCAT
GCTCTGCCATCTTAATCAGTTATAGGTAAACATTGGAAACTCCATAGAATAAATCAGTAT
TTCTACAGAAAAATGGCATAGAAGTCAGTATTGAATGTATTAAATTGGCTTTCTTCTTCA
GGAAAAACTAGACCAGACCTCTGTTATCTTCTGTGAAATCATCCTACAAGCAAACTAACC
TGGAATCCCTTCACCTAGAGATAATGTACAAGCCTTAGAACTCCTCATTCTCATGTTGCT
ATTTATGTACCTAATTAAAACCCAAGTTTAAAAAAAAAAAAAAAAAAAAAAAAAAAAAA
AAAAAAA

FIGURE 298

MFKVIQRSVGPASLSLLTFKVYAAPKKDSPPKNSVKVDELSLYSVPEGQSKYVEEARSQL
EESISQLRHYCEPYTTWCQETYSQTKPKMQSLVQWGLDSYDYLQNAPPGFFPRLGVIGFA
GLIGLLLARGSKIKKLVYPPGFMGLAASLYYPQQAIVFAQVSGERLYDWGLRGYIVIEDL
WKENFQKPGNVKNSPGTK

Important features:
Signal peptide:
Amino acids 1-23

Transmembrane domain:
Amino acids 111-130 cAMP- and cGMP-dependent protein kinase phosphorylation site:
Amino acids 26-30

Tyrosine kinase phosphorylation site:
Amino acids 36-44

N-myristoylation sites:
Amino acids 124-130;144-150;189-195

FIGURE 299

CCGCTGAGATGTACGAACTTCCGGTTCTCCGGGCAGCTGCCACTGCTGTAGCTTCTGCCA
CCTGCCACGACCGGGCCTCTCCCTGGCGTTTGGTCACCTCTGCTTCATTCTCCACCGCGC
CTATGGTCCCTCTTGGAGCCAGCGTGGCGGGCCTGGCGGCTCCCGGGTGGTGAGAGAGCG
GTCCGGGAACG<u>ATG</u>AAGGCCTCGCAGTGCTGCTGCTGTCTCAGCCACCTCTTGGCTTCCG
TCCTCCTCCTGCTGTTGCTGCCTGAACTAAGCGGGCCCCTGGCAGTCCTGCTGCAGGCAG
CCGAGGCCGCGCCAGGTCTTGGGCCTCCTGACCCTAGACCACGGACATTACCGCCGCTGC
CACCGGGCCCTACCCCTGCCCAGCAGCCGGGCCGTGGTCTGGCTGAAGCTGCGGGGCCGC
GGGGCTCCGAGGGAGGCAATGGCAGCAACCCTGTGGCCGGGCTTGAGACGGACGATCACG
GAGGGAAGGCCGGGGAAGGCTCGGTGGGTGGCGGCCTTGCTGTGAGCCCCAACCCTGGCG
ACAAGCCCATGACCCAGCGGGCCCTGACCGTGTTGATGGTGGTGAGCGGCGCGGTGCTGG
TGTACTTCGTGGTCAGGACGGTCAGGATGAGAAGAAGAAACCGAAAGACTAGGAGATATG
GAGTTTTGGACACTAACATAGAAAATATGGAATTGACACCTTTAGAACAGGATGATGAGG
ATGATGACAACACGTTGTTTGATGCCAATCATCCTCGAAGA<u>TAA</u>GAATGTGCCTTTTGAT
GAAAGAACTTTATCTTTCTACAATGAAGAGTGGAATTTCTATGTTTAAGGAATAAGAAGC
CACTATATCAATGTTGGGGGGTATTTAAGTTACATATATTTTAACAACCTTTAATTTGC
TGTTGCAATAAATACCGTATCCTTTTATTATATCTTTATATGTATAGAAGTACTCTATTA
ATGGGCTCAGAGATGTTGGGGATAAAGTATACTGTAATAATTTATCTGTTTGAAAATTAC
TATAAAACGGTGTTTTCTGGTCGGTTTTGTTTCCTGCTTACCATATGATTGTAAATTGT
TTTATGTATTAATCAGTTAATGCTAATTATTTTGCTGATGTCATATGTTAAAGAGCTAT
AAATTCCAACAACCAACTGGTGTGTAAAAATAATTTAAAATTTCCTTTACTGAAAGGTAT
TTCCCATTTTTGTGGGAAAAGAAGCCAAATTTATTACTTTGTGTTGGGGTTTTTAAAAT
ATTAAGAAATGTCTAAGTTATTGTTTGCAAAACAATAAATATGATTTTAAATTCTCTTAA
AAAAAAAA

FIGURE 300

MKASQCCCCLSHLLASVLLLLLLPELSGPLAVLLQAAEAAPGLGPPDPRPRTLPPLPPGP
TPAQQPGRGLAEAAGPRGSEGGNGSNPVAGLETDDHGGKAGEGSVGGGLAVSPNPGDKPM
TQRALTVLMVVSGAVLVYFVVRTVRMRRRNRKTRRYGVLDTNIENMELTPLEQDDEDDDN
TLFDANHPRR

Signal peptide:
amino acids 1-28

Transmembrane domain:
amino acids 124-140

N-glycosylation site:
amino acids 83-87

N-myristoylation sites:
amino acids 69-75, 78-84, 81-87, 97-103, 103-109, 106-112, 157-160

FIGURE 301

CTCGGCTGGATTTAAGGTTGCCGCTAGCCGCCTGGGAATTTAAGGGACCCACACTACCTT
CCCGAAGTTGAAGGCAAGCGGTGATTGTTTGTAGACGGCGCTTTGTCATGGGACCTGTGC
GGTTGGGAATATTGCTTTTCCTTTTTTTGGCCGTGCACGAGGCTTGGGCTGGGATGTTGA
AGGAGGAGGACGATGACACAGAACGCTTGCCCAGCAAATGCGAAGTGTGTAAGCTGCTGA
GCACAGAGCTACAGGCGGAACTGAGTCGCACCGGTCGATCTCGAGAGGTGCTGGAGCTGG
GGCAGGTGCTGGATACAGGCAAGAGGAAGAGACACGTGCCTTACAGCGTTTCAGAGACAA
GGCTGGAAGAGGCCTTAGAGAATTTATGTGAGCGGATCCTGGACTATAGTGTTCACGCTG
AGCGCAAGGGCTCACTGAGATATGCCAAGGGTCAGAGTCAGACCATGGCAACACTGAAAG
GCCTAGTGCAGAAGGGGTGAAGGTGGATCTGGGGATCCCTCTGGAGCTTTGGGATGAGC
CCAGCGTGGAGGTCACATACCTCAAGAAGCAGTGTGAGACCATGTTGGAGGAGTTTGAAG
ACATTGTGGGAGACTGGTACTTCCACCATCAGGAGCAGCCCCTACAAAATTTTCTCTGTG
AAGGTCATGTGCTCCCAGCTGCTGAAACTGCATGTCTACAGGAAACTTGGACTGGAAAGG
AGATCACAGATGGGGAAGAGAAAACAGAAGGGGAGGAAGAGCAGGAGGAGGAGGAGGAAG
AGGAGGAAGAGGAAGGGGGAGACAAGATGACCAAGACAGGAAGCCACCCCAAACTTGACC
GAGAAGATCTTTTGACCCTTGCCTTTGAGCCCCAGGAGGGGAAGGGATCATGGAGAGCCC
TCTAAAGCCTGCACTCTCCCTGCTCCACAGCTTTCAGGGTGTGTTTATGAGTGACTCCAC
CCAAGCTTGTAGCTGTTCTCTCCCATCTAACCTCAGGCAAGATCCTGGTGAAACAGCATG
ACATGGCTTCTGGGGTGGAGGGTGGGGGTGGAGGTCCTGCTCCTAGAGATGAACTCTATC
CAGCCCCTTAATTGGCAGGTGTATGTGCTGACAGTACTGAAAGCTTTCCTCTTTAACTGA
TCCCACCCCCACCCAAAAGTCAGCAGTGGCACTGGAGCTGTGGGCTTTGGGGAAGTCACT
TAGCTCCTTAAGGTCTGTTTTTAGACCCTTCCAAGGAAGAGGCCAGAACGGACATTCTCT
GCGATCTATATACATTGCCTGTATCCAGGAGGCTACACACCAGCAAACCGTGAAGGAGAA
TGGGACACTGGTCATGGCCTGGAGTTGCTGATAATTTAGGTGGGATAGATACTTGGTCT
ACTTAAGCTCAATGTAACCCAGAGCCCACCATATAGTTTTATAGGTGCTCAACTTTCTAT
ATCGCTATTAAACTTTTTTCTTTTTTTCTA

FIGURE 302

MGPVRLGILLFLFLAVHEAWAGMLKEEDDDTERLPSKCEVCKLLSTELQAELSRTGRSRE
VLELGQVLDTGKRKRHVPYSVSETRLEEALENLCERILDYSVHAERKGSLRYAKGQSQTM
ATLKGLVQKGVKVDLGIPLELWDEPSVEVTYLKKQCETMLEEFEDIVGDWYFHHQEQPLQ
NFLCEGHVLPAAETACLQETWTGKEITDGEEKTEGEEEQEEEEEEEEEGGDKMTKTGSH
PKLDREDL

Important features of the protein:
Signal peptide:
amino acids 1-21 cAMP- and cGMP-dependent protein kinase phosphorylation site:
amino acids 106-110

N-myristoylation site:
amino acids 115-121

Amidation site:
amino acids 70-74

FIGURE 303

CTCCTGCACTAGGCTCTCAGCCAGGGATGATGCGCTGCTGCCGCCGCCGCTGCTGCTGCC
GGCAACCACCCCATGCCCTGAGGCCGTTGCTGTTGCTGCCCCTCGTCCTTTTACCTCCCC
TGGCAGCAGCTGCAGCGGGCCCAAACCGATGTGACACCATATACCAGGGCTTCGCCGAGT
GTCTCATCCGCTTGGGGGACAGCATGGGCCGCGGAGGCGAGCTGGAGACCATCTGCAGGT
CTTGGAATGACTTCCATGCCTGTGCCTCTCAGGTCCTGTCAGGCTGTCCGGAGGAGGCAG
CTGCAGTGTGGGAATCACTACAGCAAGAAGCTCGCCAGGCCCCCGTCCGAATAACTTGC
ACACTCTGTGCGGTGCCCCGGTGCATGTTCGGGAGCGCGGCACAGGCTCCGAAACCAACC
AGGAGACGCTGCGGGCTACAGCGCCTGCACTCCCCATGGCCCCTGCGCCCCACTGCTGG
CGGCTGCTCTGGCTCTGGCCTACCTCCTGAGGCCTCTGGCCTAGCTTGTTGGGTTGGGTA
GCAGCGCCCGTACCTCCAGCCCTGCTCTGGCGGTGGTTGTCCAGGCTCTGCAGAGCGCAG
CAGGGCTTTTCATTAAAGGTATTTATATTTGTA

FIGURE 304

MMRCCRRRCCCRQPPHALRPLLLLPLVLLPPLAAAAAGPNRCDTIYQGFAECLIRLGDSM
GRGGELETICRSWNDFHACASQVLSGCPEEAAAVWESLQQEARQAPRPNNLHTLCGAPVH
VRERGTGSETNQETLRATAPALPMAPAPPLLAAALALAYLLRPLA

Signal peptide:
Amino acids 1-35

Transmembrane domain:
Amino acids 141-157

N-myristoylation site:
Amino acids 127-133

Prokaryotic membrane lipoprotein lipid attachment site:
Amino acids 77-88

FIGURE 305

AAGTACTTGTGTCCGGGTGGTGGACTGGATTAGCTGCGGAGCCCTGGAAGCTGCCTGTCC
TTCTCCCTGTGCTTAACCAGAGGTGCCCATGGGTTGGACAATGAGGCTGGTCACAGCAGC
ACTGTTACTGGGTCTCATGATGGTGGTCACTGGAGACGAGGATGAGAACAGCCCGTGTGC
CCATGAGGCCCTCTTGGACGAGGACACCCTCTTTTGCCAGGGCCTTGAAGTTTTCTACCC
AGAGTTGGGGAACATTGGCTGCAAGGTTGTTCCTGATTGTAACAACTACAGACAGAAGAT
CACCTCCTGGATGGAGCCGATAGTCAAGTTCCCGGGGGCCGTGGACGGCGCAACCTATAT
CCTGGTGATGGTGGATCCAGATGCCCCTAGCAGAGCAGAACCCAGACAGAGATTCTGGAG
ACATTGGCTGGTAACAGATATCAAGGGCGCCGACCTGAAGAAAGGGAAGATTCAGGGCCA
GGAGTTATCAGCCTACCAGGCTCCCTCCCCACCGGCACACAGTGGCTTCCATCGCTACCA
GTTCTTTGTCTATCTTCAGGAAGGAAAAGTCATCTCTCTCCTTCCCAAGGAAAACAAAAC
TCGAGGCTCTTGGAAAATGGACAGATTTCTGAACCGCTTCCACCTGGGCGAACCTGAAGC
AAGCACCCAGTTCATGACCCAGAACTACCAGGACTCACCAACCCTCCAGGCTCCCAGAGG
AAGGGCCAGCGAGCCCAAGCACAAAACCAGGCAGAGATAGCTGCCTGCTAGATAGCCGGC
TTTGCCATCCGGGCATGTGGCCACACTGCTCACCACCGACGATGTGGGTATGGAACCCCC
TCTGGATACAGAACCCCTTCTTTTCCAAATTAAAAAAAAAAATCATCAAA

FIGURE 306

MGWTMRLVTAALLLGLMMVVTGDEDENSPCAHEALLDEDTLFCQGLEVFYPELGNIGCKV
VPDCNNYRQKITSWMEPIVKFPGAVDGATYILVMVDPDAPSRAEPRQRFWRHWLVTDIKG
ADLKKGKIQGQELSAYQAPSPPAHSGFHRYQFFVYLQEGKVISLLPKENKTRGSWKMDRF
LNRFHLGEPEASTQFMTQNYQDSPTLQAPRGRASEPKHKTRQR

Important features of the protein:
Signal peptide:
amino acids 1-22

N-glycosylation site:
amino acids 169-173

Tyrosine kinase phosphorylation site:
amino acids 59-68

N-myristoylation sites:
amino acids 54-60, 83-89, 130-136

Phosphatidylethanolamine signature:
amino acids 113-157

FIGURE 307

```
AAGGAGCAGCCCGCAAGCACCAAGTGAGAGGCATGAAGTTACAGTGTGTTTCCCTTTGGC
TCCTGGGTACAATACTGATATTGTGCTCAGTAGACAACCACGGTCTCAGGAGATGTCTGA
TTTCCACAGACATGCACCATATAGAAGAGAGTTTCCAAGAAATCAAAAGAGCCATCCAAG
CTAAGGACACCTTCCCAAATGTCACTATCCTGTCCACATTGGAGACTCTGCAGATCATTA
AGCCCTTAGATGTGTGCTGCGTGACCAAGAACCTCCTGGCGTTCTACGTGGACAGGGTGT
TCAAGGATCATCAGGAGCCAAACCCCAAAATCTTGAGAAAAATCAGCAGCATTGCCAACT
CTTTCCTCTACATGCAGAAAACTCTGCGGCAATGTCAGGAACAGAGGCAGTGTCACTGCA
GGCAGGAAGCCACCAATGCCACCAGAGTCATCCATGACAACTATGATCAGCTGGAGGTCC
ACGCTGCTGCCATTAAATCCCTGGGAGAGCTCGACGTCTTTCTAGCCTGGATTAATAAGA
ATCATGAAGTAATGTTCTCAGCTTGATGACAAGGAACCTGTATAGTGATCCAGGGATGAA
CACCCCCTGTGCGGTTTACTGTGGGAGACAGCCCACCTTGAAGGGGAAGGAGATGGGGAA
GGCCCCTTGCAGCTGAAAGTCCCACTGGCTGGCCTCAGGCTGTCTTATTCCGCTTGAAAA
TAGGCAAAAAGTCTACTGTGGTATTTGTAATAAACTCTATCTGCTGAAAGGGCCTGCAGG
CCATCCTGGGAGTAAAGGGCTGCCTTCCCATCTAATTTATTGTAAAGTCATATAGTCCAT
GTCTGTGATGTGAGCCAAGTGATATCCTGTAGTACACATTGTACTGAGTGGTTTTTCTGA
ATAAATTCCATATTTTACCTATGA
```

FIGURE 308

MKLQCVSLWLLGTILILCSVDNHGLRRCLISTDMHHIEESFQEIKRAIQAKDTFPNVTIL
STLETLQIIKPLDVCCVTKNLLAFYVDRVFKDHQEPNPKILRKISSIANSFLYMQKTLRQ
CQEQRQCHCRQEATNATRVIHDNYDQLEVHAAAIKSLGELDVFLAWINKNHEVMFSA

Signal sequence:
amino acids 1-18

N-glycosylation sites:
amino acids 56-60, 135-139 cAMP- and cGMP-dependent protein kinase phosphorylation site:
amino acids 102-106

N-myristoylation site:
amino acids 24-30

Actinin-type actin-binding domain signature 1:
amino acids 159-169

FIGURE 309

GTCGACCCACGCGTCCGAAGCTGCTGGAGCCACGATTCAGTCCCCTGGACTGTAGATAAA
GACCCTTTCTTGCCAGGTGCTGAGACAACCACACTATGAGAGGCACTCCAGGAGACGCTG
ATGGTGGAGGAAGGGCCGTCTATCAATCAATCACTGTTGCTGTTATCACATGCAAGTATC
CAGAGGCTCTTGAGCAAGGCAGAGGGGATCCATTTATTTGGGAATCCAGAATCCAGAAA
TGTGTTTGTATTGTGAGAAGGTTGGAGAACAGCCCACATTGCAGCTAAAAGAGCAGAAGA
TCATGGATCTGTATGGCCAACCCGAGCCCGTGAAACCCTTCCTTTTCTACCGTGCCAAGA
CTGGTAGGACCTCCACCCTTGAGTCTGTGGCCTTCCCGGACTGGTTCATTGCCTCCTCCA
AGAGAGACCAGCCCATCATTCTGACTTCAGAACTTGGGAAGTCATACAACACTGCCTTTG
AATTAAATATAAATGACTGAACTCAGCCTAGAGGTGGCAGCTTGGTCTTTGTCTTAAAGT
TTCTGGTTCCCAATGTGTTTTCGTCTACATTTTCTTAGTGTCATTTTCACGCTGGTGCTG
AGACAGGAGCAAGGCTGCTGTTATCATCTCATTTTATAATGAAGAAGAAGCAATTACTTC
ATAGCAACTGAAGAACAGGATGTGGCCTCAGAAGCAGGAGAGCTGGGTGGTATAAGGCTG
TCCTCTCAAGCTGGTGCTGTGTAGGCCACAAGGCATCTGCATGAGTGACTTTAAGACTCA
AAGACCAAACACTGAGCTTTCTTCTAGGGGTGGGTATGAAGATGCTTCAGAGCTCATGCG
CGTTACCCACGATGGCATGACTAGCACAGAGCTGATCTCTGTTTCTGTTTTGCTTTATTC
CCTCTTGGGATGATATCATCCAGTCTTTATATGTTGCCAATATACCTCATTGTGTGTAAT
AGAACCTTCTTAGCATTAAGACCTTGTAAACAAAAATAATTCTTGGGGTGGGTATGAAGA
TGCTTCAGAGCTCATGCGCGTTACCCACGATGGCATGACTAGCACAGAGCTGATCTCTGT
TTCTGTTTTGCTTTATTCCCTCTTGGGATGATATCATCCAGTCTTTATATGTTGCCAATA
TACCTCATTGTGTGTAATAGAACCTTCTTAGCATTAAGACCTTGTAAACAAAAATAATTC
TTGTGTTAAGTTAAATCATTTTTGTCCTAATTGTAATGTGTAATCTTAAAGTTAAATAAA
CTTTGTGTATTTATATAATAATAAAGCTAAACTGATATAAAATAAAGAAAGAGTAAACTG

FIGURE 310

MRGTPGDADGGGRAVYQSITVAVITCKYPEALEQGRGDPIYLGIQNPEMCLYCEKVGEQP
TLQLKEQKIMDLYGQPEPVKPFLFYRAKTGRTSTLESVAFPDWFIASSKRDQPIILTSEL
GKSYNTAFELNIND

Signal sequence:
amino acids 1-17

N-myristoylation site:
amino acids 10-16

Cell attachment sequence:
amino acids 36-39

FIGURE 311

GCGAGGCTGCACCAGCGCCTGGCACCATGAGGACGCCTGGGCCTCTGCCCGTGCTGCTGC
TGCTCCTGGCGGGAGCCCCCGCCGCGCGGCCCACTCCCCCGACCTGCTACTCCCGCATGC
GGGCCCTGAGCCAGGAGATCACCCGCGACTTCAACCTCCTGCAGGTCTCGGAGCCCTCGG
AGCCATGTGTGAGATACCTGCCCAGGCTGTACCTGGACATACACAATTACTGTGTGCTGG
ACAAGCTGCGGGACTTTGTGGCCTCGCCCCGTGTTGGAAAGTGGCCCAGGTAGATTCCT
TGAAGGACAAAGCACGGAAGCTGTACACCATCATGAACTCGTTCTGCAGGAGAGATTTGG
TATTCCTGTTGGATGACTGCAATGCCTTGGAATACCCAATCCCAGTGACTACGGTCCTGC
CAGATCGTCAGCGCTAAGGGAACTGAGACCAGAGAAAGAACCCAAGAGAACTAAAGTTAT
GTCAGCTACCCAGACTTAATGGGCCAGAGCCATGACCCTCACAGGTCTTGTGTTAGTTGT
ATCTGAAACTGTTATGTATCTCTCTACCTTCTGGAAAACAGGGCTGGTATTCCTACCCAG
GAACCTCCTTTGAGCATAGAGTTAGCAACCATGCTTCTCATTCCCTTGACTCATGTCTTG
CCAGGATGGTTAGATACACAGCATGTTGATTTGGTCACTAAAAGAAGAAAGGACTAAC
AAGCTTCACTTTATGAACAACTATTTTGAGAACATGCACAATAGTATGTTTTTATTACT
GGTTTAATGGAGTAATGGTACTTTTATTCTTTCTTGATAGAAACCTGCTTACATTTAACC
AAGCTTCTATTATGCCTTTTTCTAACACAGACTTTCTTCACTGTCTTTCATTTAAAAAGA
AATTAATGCTCTTAAGATATATATTTTACGTAGTGCTGACAGGACCCACTCTTTCATTGA
AAGGTGATGAAAATCAAATAAAGAATCTCTTCACATGGA

FIGURE 312

MRTPGPLPVLLLLLAGAPAARPTPPTCYSRMRALSQEITRDFNLLQVSEPSEPCVRYLPR
LYLDIHNYCVLDKLRDFVASPPCWKVAQVDSLKDKARKLYTIMNSFCRRDLVFLLDDCNA
LEYPIPVTTVLPDRQR

Important features of the protein:
Signal peptide:
amino acids 1-19

Tyrosine kinase phosphorylation site:
amino acids 60-69

N-myristoylation site:
amino acids 16-22

FIGURE 313

GAGCGACGCTGTCTCTAGTCGCTGATCCCAAATGCACCGGCTCATCTTTGTCTACACTCT
AATCTGCGCAAACTTTTGCAGCTGTCGGGACACTTCTGCAACCCCGCAGAGCGCATCCAT
CAAAGCTTTGCGCAACGCCAACCTCAGGCGAGATGACTTGTACCGAAGAGATGAGACCAT
CCAGGTGAAAGGAAACGGCTACGTGCAGAGTCCTAGATTCCCGAACAGCTACCCCAGGAA
CCTGCTCCTGACATGGCGGCTTCACTCTCAGGAGAATACACGGATACAGCTAGTGTTTGA
CAATCAGTTTGGATTAGAGGAAGCAGAAAATGATATCTGTAGGTATGATTTTGTGGAAGT
TGAAGATATATCCGAAACCAGTACCATTATTAGAGGACGATGGTGTGGACACAAGGAAGT
TCCTCCAAGGATAAAATCAAGAACGAACCAAATTAAAATCACATTCAAGTCCGATGACTA
CTTTGTGGCTAAACCTGGATTCAAGATTTATTATTCTTTGCTGGAAGATTTCCAACCCGC
AGCAGCTTCAGAGACCAACTGGGAATCTGTCACAAGCTCTATTTCAGGGGTATCCTATAA
CTCTCCATCAGTAACGGATCCCACTCTGATTGCGGATGCTCTGGACAAAAAAATTGCAGA
ATTTGATACAGTGGAAGATCTGCTCAAGTACTTCAATCCAGAGTCATGGCAAGAAGATCT
TGAGAATATGTATCTGGACACCCCTCGGTATCGAGGCAGGTCATACCATGACCGGAAGTC
AAAAGTTGACCTGGATAGGCTCAATGATGATGCCAAGCGTTACAGTTGCACTCCCAGGAA
TTACTCGGTCAATATAAGAGAAGAGCTGAAGTTGGCCAATGTGGTCTTCTTTCCACGTTG
CCTCCTCGTGCAGCGCTGTGGAGGAAATTGTGGCTGTGGAACTGTCAACTGGAGGTCCTG
CACATGCAATTCAGGGAAAACCGTGAAAAGTATCATGAGGTATTACAGTTTGAGCCTGG
CCACATCAAGAGGAGGGGTAGAGCTAAGACCATGGCTCTAGTTGACATCCAGTTGGATCA
CCATGAACGATGCGATTGTATCTGCAGCTCAAGACCACCTCGATAAGAGAATGTGCACAT
CCTTACATTAAGCCTGAGAGAA

FIGURE 314

MHRLIFVYTLICANFCSCRDTSATPQSASIKALRNANLRRDDLYRRDETIQVKGNGYVQS
PRFPNSYPRNLLLTWRLHSQENTRIQLVFDNQFGLEEAENDICRYDFVEVEDISETSTII
RGRWCGHKEVPPRIKSRTNQIKITFKSDDYFVAKPGFKIYYSLLEDFQPAAASETNWESV
TSSISGVSYNSPSVTDPTLIADALDKKIAEFDTVEDLLKYFNPESWQEDLENMYLDTPRY
RGRSYHDRKSKVDLDRLNDDAKRYSCTPRNYSVNIREELKLANVVFFPRCLLVQRCGGNC
GCGTVNWRSCTCNSGKTVKKYHEVLQFEPGHIKRRGRAKTMALVDIQLDHHERCDCICSS
RPPR

Signal peptide:
amino acids 1-18

N-glycosylation site:
amino acids 270-274 cAMP- and cGMP-dependent protein kinase phosphorylation site:
amino acids 262-266

Tyrosine kinase phosphorylation site:
amino acids 256-265

N-myristoylation sites:
amino acids 94-100, 186-192, 297-303, 298-304

TonB-dependent receptor proteins signature 1:
amino acids 1-56

FIGURE 315

```
CGGCTCGAGGCTCCCGCCAGGAGAAAGGAACATTCTGAGGGGAGTCTACACCCTGTGGAG
CTCAAGATGGTCCTGAGTGGGGCGCTGTGCTTCCGAATGAAGGACTCGGCATTGAAGGTG
CTTTATCTGCATAATAACCAGCTTCTAGCTGGAGGGCTGCATGCAGGGAAGGTCATTAAA
GGTGAAGAGATCAGCGTGGTCCCCAATCGGTGGCTGGATGCCAGCCTGTCCCCGTCATC
CTGGGTGTCCAGGGTGGAAGCCAGTGCCTGTCATGTGGGGTGGGGCAGGAGCCGACTCTA
ACACTAGAGCCAGTGAACATCATGGAGCTCTATCTTGGTGCCAAGGAATCCAAGAGCTTC
ACCTTCTACCGGCGGGACATGGGGCTCACCTCCAGCTTCGAGTCGGCTGCCTACCCGGGC
TGGTTCCTGTGCACGGTGCCTGAAGCCGATCAGCCTGTCAGACTCACCCAGCTTCCCGAG
AATGGTGGCTGGAATGCCCCCATCACAGACTTCTACTTCCAGCAGTGTGACTAGGGCAAC
GTGCCCCCAGAACTCCCTGGGCAGAGCCAGCTCGGGTGAGGGGTGAGTGGAGGAGACCC
ATGGCGGACAATCACTCTCTCTGCTCTCAGGACCCCCACGTCTGACTTAGTGGGCACCTG
ACCACTTTGTCTTCTGGTTCCCAGTTTGGATAAATTCTGAGATTTGGAGCTCAGTCCACG
GTCCTCCCCCACTGGATGGTGCTACTGCTGTGGAACCTTGTAAAAACCATGTGGGGTAAA
CTGGGAATAACATGAAAAGATTTCTGTGGGGTGGGGTGGGGAGTGGTGGGAATCATTC
CTGCTTAATGGTAACTGACAAGTGTTACCCTGAGCCCCGCAGGCCAACCCATCCCCAGTT
GAGCCTTATAGGGTCAGTAGCTCTCCACATGAAGTCCTGTCACTCACCACTGTGCAGGAG
AGGGAGGTGGTCATAGAGTCAGGGATCTATGGCCCTTGGCCCAGCCCCACCCCCTTCCCT
TTAATCCTGCCACTGTCATATGCTACCTTTCCTATCTCTTCCCTCATCATCTTGTTGTGG
GCATGAGGAGGTGGTGATGTCAGAAGAAATGGCTCGAGCTCAGAAGATAAAGATAAGTA
GGGTATGCTGATCCTCTTTTAAAAACCCAAGATACAATCAAAATCCCAGATGCTGGTCTC
TATTCCCATGAAAAGTGCTCATGACATATTGAGAAGACCTACTTACAAAGTGGCATATA
TTGCAATTTATTTTAATTAAAAGATACCTATTTATATATTTCTTTATAGAAAAAAGTCTG
GAAGAGTTTACTTCAATTGTAGCAATGTCAGGGTGGTGGCAGTATAGGTGATTTTTCTTT
TAATTCTGTTAATTTATCTGTATTTCCTAATTTTTCTACAATGAAGATGAATTCCTTGTA
TAAAAATAAGAAAGAAATTAATCTTGAGGTAAGCAGAGCAGACATCATCTCTGATTGTC
CTCAGCCTCCACTTCCCCAGAGTAAATTCAAATTGAATCGAGCTCTGCTGCTCTGGTTGG
TTGTAGTAGTGATCAGGAAACAGATCTCAGCAAAGCCACTGAGGAGGAGGCTGTGCTGAG
TTTGTGTGGCTGGAATCTCTGGGTAAGGAACTTAAAGAACAAAAATCATCTGGTAATTCT
TTCCTAGAAGGATCACAGCCCCTGGGATTCCAAGGCATTGGATCCAGTCTCTAAGAAGGC
TGCTGTACTGGTTGAATTGTGTCCCCCTCAAATTCACATCCTTCTTGGAATCTCAGTCTG
TGAGTTTATTTGGAGATAAGGTCTCTGCAGATGTAGTTAGTTAAGACAAGGTCATGCTGG
ATGAAGGTAGACCTAAATTCAATATGACTGGTTTCCTTGTATGAAAAGGAGAGGACACAG
AGACAGAGGAGACGCGGGGAAGACTATGTAAAGATGAAGGCAGAGATCGGAGTTTTGCAG
CCACAAGCTAAGAAACACCAAGGATTGTGGCAACCATCAGAAGCTTGGAAGAGGCAAAGA
AGAATTCTTCCCTAGAGGCTTTAGAGGGATAACGGCTCTGCTGAAACCTTAATCTCAGAC
TTCCAGCCTCCTGAACGAAGAAAGAATAAATTTCGGCTGTTTTAAGCCACCAAGGATAAT
TGGTTACAGCAGCTCTAGGAAACTAATACAGCTGCTAAAATGATCCCTGTCTCCTCGTGT
TTACATTCTGTGTGTGTCCCCTCCCACAATGTACCAAAGTTGTCTTTGTGACCAATAGAA
TATGGCAGAAGTGATGGCATGCCACTTCCAAGATTAGGTTATAAAAGACACTGCAGCTTC
TACTTGAGCCCTCTCTCTCTGCCACCCACCGCCCCAATCTATCTTGGCTCACTCGCTCT
GGGGGAAGCTAGCTGCCATGCTATGAGCAGGCCTATAAAGAGACTTACGTGGTAAAAAT
GAAGTCTCCTGCCCACAGCCACATTAGTGAACCTAGAAGCAGAGACTCTGTGAGATAATC
GATGTTTGTTGTTTTAAGTTGCTCAGTTTTGGTCTAACTTGTTATGCAGCAATAGATAAA
TAATATGCAGAGAAAGAG
```

FIGURE 316

MVLSGALCFRMKDSALKVLYLHNNQLLAGGLHAGKVIKGEEISVVPNRWLDASLSPVILG
VQGGSQCLSCGVGQEPTLTLEPVNIMELYLGAKESKSFTFYRRDMGLTSSFESAAYPGWF
LCTVPEADQPVRLTQLPENGGWNAPITDFYFQQCD

N-myristoylation sites:
amino acids 29-34, 30-35, 60-65, 63-68, 73-78, 91-96, 106-111

Interleukin-1 signature:
amino acids 111-131

Interleukin-1 proteins:
amino acids 8-29, 83-120, 95-134, 64-103

FIGURE 317

ATGGAACTTGGACTTGGAGGCCTCTCCACGCTGTCCCACTGCCCCTGGCCTAGGCGGCAG
CCTGCCCTGTGGCCCACCCTGGCCGCTCTGGCTCTGCTGAGCAGCGTCGCAGAGGCCTCC
CTGGGCTCCGCGCCCCGCAGCCCTGCCCCCCGCGAAGGCCCCCCGCCTGTCCTGGCGTCC
CCCGCCGGCCACCTGCCGGGGGGACGCACGGCCCGCTGGTGCAGTGGAAGAGCCCGGCGG
CCGCCGCCGCAGCCTTCTCGGCCCGCGCCCCGCCGCCTGCACCCCATCTGCTCTTCCC
CGCGGGGGCCGCGCGGCGCGGGCTGGGGCCCGGGCAGCCGCGCTCGGGCAGCGGGGGCG
CGGGGCTGCCGCCTGCGCTCGCAGCTGGTGCCGGTGCGCGCGCTCGGCCTGGGCCACCGC
TCCGACGAGCTGGTGCGTTTCCGCTTCTGCAGCGGCTCCTGCCGCCGCGCGCTCTCCA
CACGACCTCAGCCTGGCCAGCCTACTGGGCGCCGGGGCCCTGCGACCGCCCCGGGCTCC
CGGCCCGTCAGCCAGCCCTGCTGCCGACCCACGCGCTACGAAGCGGTCTCCTTCATGGAC
GTCAACAGCACCTGGAGAACCGTGGACCGCCTCTCCGCCACCGCCTGCGGCTGCCTGGGC
TGA

FIGURE 318

MELGLGGLSTLSHCPWPRRQPALWPTLAALALLSSVAEASLGSAPRSPAPREGPPPVLAS
PAGHLPGGRTARWCSGRARRPPPQPSRPAPPPPAPPSALPRGGRAARAGGPGSRARAAGA
RGCRLRSQLVPVRALGLGHRSDELVRFRFCSGSCRRARSPHDLSLASLLGAGALRPPPGS
RPVSQPCCRPTRYEAVSFMDVNSTWRTVDRLSATACGCLG signal sequence:
Amino acids 1-39

N-glycosylation site:
Amino acids 202-206

N-myristoylation sites:
Amino acids 6-12;67-73;102-108;109-115;119-125

FIGURE 319

GTTGCTATGTTGCCCAGGCTGGTCTTGAAGTGCCTTGACCTCCTAAAGTGTTGGAACCAC
AGACGTGAGCCACTCCACCCAGCCTAAAACTTCATCTTCTTTGGATGAGATGAACACTTT
TAACAAGAGAACAGGACTCTATATAAATCGCTGTGGGCTCACCACCTCTAAGGAGGAGCA
CTGACTGAAGACAGAAAAATTGATGAACTGAAGAAGACATGGTCCATTATGCCTTACAAA
CTTACACAGTGCTTTGGGAATTCCAAAGTACTCAGTGGAGAGAGGTGTTTCAGGAGCCGT
AGAGCCAGATCGTCATCATGTCTGCATTGTGGCTGCTGCTGGGCCTCCTTGCCCTGATGG
ACTTGTCTGAAAGCAGCAACTGGGGATGCTATGGAAACATCCAAAGCCTGGACACCCTG
GAGCATCTTGTGGGATTGGAAGACGTCACGGCCTGAACTACTGTGGAGTTCGTGCTTCTG
AAAGGCTGGCTGAAATAGACATGCCATACCTCCTGAAATATCAACCCATGATGCAAACCA
TTGGCCAAAAGTACTGCATGGATCCTGCCGTGATCGCTGGTGTCTTGTCCAGGAAGTCTC
CCGGTGACAAAATTCTGGTCAACATGGGCGATAGGACTAGCATGGTGCAGGACCCTGGCT
CTCAAGCTCCCACATCCTGGATTAGTGAGTCTCAGGTTTCCCAGACAACTGAAGTTCTGA
CTACTAGAATCAAAGAAATCCAGAGGAGGTTTCCAACCTGGACCCCTGACCAGTACCTGA
GAGGTGGACTCTGTGCCTACAGTGGGGGTGCTGGCTATGTCCGAAGCAGCCAGGACCTGA
GCTGTGACTTCTGCAATGATGTCCTTGCACGAGCCAAGTACCTCAAGAGACATGGCTTCT
AACATCTCAGATGAAACCCAAGACCATGATCACATATGCAGCCTCAAATGTTACACAGAT
AAAACTAGCCAAGGGCACCTGTAACTGGGAATCTGAGTTTGACCTAAAAGTCATTAAAAT
AACATGAATCCCATTAAAAAAAAAAAAAA

FIGURE 320

MSALWLLLGLLALMDLSESSNWGCYGNIQSLDTPGASCGIGRRHGLNYCGVRASERLAEI
DMPYLLKYQPMMQTIGQKYCMDPAVIAGVLSRKSPGDKILVNMGDRTSMVQDPGSQAPTS
WISESQVSQTTEVLTTRIKEIQRRFPTWTPDQYLRGGLCAYSGGAGYVRSSQDLSCDFCN
DVLARAKYLKRHGF

Important features of the protein:
Signal peptide:
amino acids 1-19

N-myristoylation sites:
amino acids 23-29, 26-32, 35-41, 45-51, 50-56, 76-82, 156-162

Amidation site:
amino acids 40-44

FIGURE 321

GCCTTATAAAGTAGCCTCTGCATCTGCCTGCCTCGGGCAGAGGAGGGCTACCCTGGGGCT
GAGAGTTCACCTGTCTCAGGAACCACCTGAGCCCACAGATCCTGTGGGCAGCGGCCAGGG
CAGCCATGGCTTGGGCAAGTAGGCTGGGCCTGCTGCTGGCACTGCTGCTGCCCGTGGTCG
GTGCCTCCACGCCAGGCACCGTGGTCCGACTCAACAAGGCAGCATTGAGCTACGTGTCTG
AAATTGGGAAAGCCCCTCTCCAGCGGGCCCTGCAGGTCACTGTCCCTCATTTCCTGGACT
GGAGTGGAGAGGCGCTTCAGCCCACCAGGATCCGGATTCTGAATGTCCATGTGCCCCGCC
TCCACCTGAAATTCATTGCTGGTTTCGGAGTGCGCCTGCTGGCAGCAGCTAATTTTACTT
TCAAGGTCTTTCGCGCCCCAGAGCCCTGGAGCTGACGCTGCCTGTGGAACTGCTGGCTG
ACACCCGCGTGACCCAGAGCTCCATCAGGACCCCTGTGGTCAGCATCTCTGCCTGCTCTT
TATTCTCGGGCCACGCCAACGAGTTTGATGGCAGTAACAGCACCTCCCACGCGCTGCTGG
TCCTGGTGCAGAAGCACATTAAAGCTGTCTTGAGTAACAAGCTGTGCCTGAGCATCTCCA
ACCTGGTGCAGGGTGTCAATGTCCACCTGGGCACCTTAATTGGCCTCAACCCCGTGGGTC
CTGAGTCCCAGATCCGCTATTCCATGGTCAGTGTGCCCACTGTCACCAGTGACTACATTT
CCCTGGAAGTCAATGCTGTTCTCTTCCTGCTGGGCAACCCCATCATCCTGCCCACGGATG
CCACCCCTTTTGTGTTGCCAAGGCATGTGGGTACCGAGGGCTCCATGGCCACCGTGGGCC
TCTCCCAGCAGCTGTTTGACTCTGCGCTCCTGCTGCTGCAGAAGGCCGGTGCCCTCAACC
TGGACATCACAGGGCAGCTGAGGTCGGATGACAACCTGCTGAACACCTCTGCTCTGGGCC
GGCTCATCCCGGAGGTGGCCCGCCAGTTTCCCGAGCCCATGCCTGTGGTGCTCAAGGTGC
GGCTGGGTGCCACACCTGTGGCCATGCTCCACACAAACAACGCCACCCTGCGGCTGCAGC
CCTTCGTGGAGGTCCTGGCCACAGCCTCCAACTCGGCTTTCCAGTCCCTCTTCTCCCTGG
ATGTGGTAGTGAACTTGAGACTCCAGCTCTCTGTGTCCAAGGTGAAGCTTCAGGGGACCA
CGTCTGTGCTGGGGGATGTCCAGCTCACGGTGGCCTCCTCCAACGTGGGCTTCATTGATA
CAGATCAGGTGCGCACACTGATGGGCACCGTTTTGAGAAGCCCTGCTGGACCATCTCA
ATGCTCTCTTGGCCATGGGAATTGCCCTCCCTGGTGTGGTCAACCTCCACTATGTTGCCC
CTGAGATCTTTGTCTATGAGGGCTACGTGGTGATATCCAGTGGACTCTTCTACCAGAGCT
GAGGCAAGACCACTGGGAGGCCTGAGAGTGGGCCAGCTCGCTGCTCAGGCGAATTTCTCA
TTTCAAGCCACTGGGGAAACTGAGGCAAAACCATACTTAGTCATCACCAACAAGCTGGAC
TGCTTAGCTGGGCTGTTTTATCTTCCCTGAGTGCCTGGGTCTCCCTCCCTCACTTCTGCC
CTTTCCCTTCCTCCTCCTCTTCTCCTCCCTCTTCCCTCATCTCCCCCCTCCTTCCTCTGC
CCCACCCCAGGGGGGAGCAGACTGCTCCTCCAGGCTGTATAGACCTGCCCTCTTGCATTA
AACAACTTCTCTTGAGCTGC

FIGURE 322

```
MAWASRLGLLLALLLPVVGASTPGTVVRLNKAALSYVSEIGKAPLQRALQVTVPHFLDWS
GEALQPTRIRILNVHVPRLHLKFIAGFGVRLLAAANFTFKVFRAPEPLELTLPVELLADT
RVTQSSIRTPVVSISACSLFSGHANEFDGSNSTSHALLVLVQKHIKAVLSNKLCLSISNL
VQGVNVHLGTLIGLNPVGPESQIRYSMVSVPTVTSDYISLEVNAVLFLLGNPIILPTDAT
PFVLPRHVGTEGSMATVGLSQQLFDSALLLLQKAGALNLDITGQLRSDDNLLNTSALGRL
IPEVARQFPEPMPVVLKVRLGATPVAMLHTNNATLRLQPFVEVLATASNSAFQSLFSLDV
VVNLRLQLSVSKVKLQGTTSVLGDVQLTVASSNVGFIDTDQVRTLMGTVFEKPLLDHLNA
LLAMGIALPGVVNLHYVAPEIFVYEGYVVISSGLFYQS
```

Important features of the protein:
Signal peptide:
Amino acids     1-20

Transmembrane domain:
Amino acids     217-236

N-glycosylation sites:
Amino acids     96-100;151-155;293-297;332-336

N-myristoylation sites:
Amino acids     8-14;149-155;189-195;249-255;252-258;283-289

LBP / BPI / CETP family proteins:
Amino acids     22-50; 251-287

FIGURE 323

TTGAAAATCTACTCTATCAGCTGCTGTGGTTGCCACCATTCTCAGGACCCTCGCCATGAA
AGCCCTTATGCTGCTCACCCTGTCTGTTCTGCTCTGCTGGGTCTCAGCTGACATTCGCTG
TCACTCCTGCTACAAGGTCCCTGTGCTGGGCTGTGTGGACCGGCAGTCCTGCCGCCTGGA
GCCAGGACAGCAATGCCTGACAACACATGCATACCTTGGTAAGATGTGGGTTTTCTCCAA
TCTGCGCTGTGGCACACCAGAAGAGCCCTGTCAGGAGGCCTTCAACCAAACCAACCGCAA
GCTGGGTCTGACATATAACACCACCTGCTGCAACAAGGACAACTGCAACAGCGCAGGACC
CCGGCCCACTCCAGCCCTGGGCCTTGTCTTCCTTACCTCCTTGGCTGGCCTTGGCCTCTG
GCTGCTGCACTGAGACTCATTCCATTGGCTGCCCCTCCTCCCACCTGCCTTGGCCTGAGC
CTCTCTCCCTGTGTCTCTGTATCCCCTGGCTTTACAGAATCGTCTCTCCCTAGCTCCCAT
TTCTTTAATTAAACACTGTTCCGAGTGGTCTCCTCATCCATCCTTCCCACCTCACACCCT
TCACTCTCCTTTTTCTGGGTCCCTTCCCACTTCCTTCCAGGACCTCCATTGGCTCCTAGA
AGGGCTCCCCACTTTGCTTCCTATACTCTGCTGTCCCCTACTTGAGGAGGGATTGGGATC
TGGGCCTGAAATGGGGCTTCTGTGTTGTCCCCAGTGAAGGCTCCCACAAGGACCTGATGA
CCTCACTGTACAGAGCTGACTCCCCAAACCCAGGCTCCCATATGTACCCCATCCCCCATA
CTCACCTCTTTCCATTTTGAGTAATAAATGTCTGAGTCTGGAAAAAAAAAAAAAAAAAA

FIGURE 324

MKALMLLTLSVLLCWVSADIRCHSCYKVPVLGCVDRQSCRLEPGQQCLTTHAYLGKMWVF
SNLRCGTPEEPCQEAFNQTNRKLGLTYNTTCCNKDNCNSAGPRPTPALGLVFLTSLAGLG
LWLLH

Important features of the protein:
Signal peptide:
amino acids 1-18

N-glycosylation sites:
amino acids 77-81, 88-92

N-myristoylation site:
amino acids 84-90

Ly-6 / u-PAR domain protein signature:
amino acids 85-98

FIGURE 325

ACGGGCCGCAGCGGCAGTGACGTAGGGTTGGCGCACGGATCCGTTGCGGCTGCAGCTCTG
CAGTCGGGCCGTTCCTTCGCCGCCGCCAGGGGTAGCGGTGTAGCTGCGCAGCGTCGCGCG
CGCTACCGCACCCAGGTTCGGCCCGTAGGCGTCTGGCAGCCCGGCGCCATCTTCATCGAG
CGCCATGGCCGCAGCCTGCGGGCCGGGAGCGGCCGGGTACTGCTTGCTCCTCGGCTTGCA
TTTGTTTCTGCTGACCGCGGGCCCTGCCCTGGGCTGGAACGACCCTGACAGAATGTTGCT
GCGGGATGTAAAGCTCTTACCCTCCACTATGACCGCTATACCACCTCCGCAGGCTGGA
TCCCATCCCACAGTTGAAATGTGTTGGAGGCACAGCTGGTTGTGATTCTTATACCCCAAA
AGTCATACAGTGTCAGAACAAAGGCTGGGATGGGTATGATGTACAGTGGGAATGTAAGAC
GGACTTAGATATTGCATACAAATTTGGAAAAACTGTGGTGAGCTGTGAAGGCTATGAGTC
CTCTGAAGACCAGTATGTACTAAGAGGTTCTTGTGGCTTGGAGTATAATTTAGATTATAC
AGAACTTGGCCTGCAGAAACTGAAGGAGTCTGGAAAGCAGCACGGCTTTGCCTCTTTCTC
TGATTATTATTATAAGTGGTCCTCGGCGGATTCCTGTAACATGAGTGGATTGATTACCAT
CGTGGTACTCCTTGGGATCGCCTTTGTAGTCTATAAGCTGTTCCTGAGTGACGGGCAGTA
TTCTCCTCCACCGTACTCTGAGTATCCTCCATTTTCCCACCGTTACCAGAGATTCACCAA
CTCAGCAGGACCTCCTCCCCCAGGCTTTAAGTCTGAGTTCACAGGACCACAGAATACTGG
CCATGGTGCAACTTCTGGTTTTGGCAGTGCTTTTACAGGACAACAAGGATATGAAAATTC
AGGACCAGGGTTCTGGACAGGCTTGGGAACTGGTGGAATACTAGGATATTTGTTTGGCAG
CAATAGAGCGGCAACACCCTTCTCAGACTCGTGGTACTACCCGTCCTATCCTCCCTCCTA
CCCTGGCACGTGGAATAGGGCTTACTCACCCCTTCATGGAGGCTCGGGCAGCTATTCGGT
ATGTTCAAACTCAGACACGAAAACCAGAACTGCATCAGGATATGGTGGTACCAGGAGACG
ATAAAGTAGAAAGTTGGAGTCAAACACTGGATGCAGAAATTTTGGATTTTTCATCACTTT
CTCTTTAGAAAAAAAGTACTACCTGTTAACAATTGGGAAAAGGGGATATTCAAAAGTTCT
GTGGTGTTATGTCCAGTGTAGCTTTTTGTATTCTATTATTTGAGGCTAAAAGTTGATGTG
TGACAAAATACTTATGTGTTGTATGTCAGTGTAACATGCAGATGTATATTGCAGTTTTTG
AAAGTGATCATTACTGTGGAATGCTAAAAATACATTAATTTCTAAAACCTGTGATGCCCT
AAGAAGCATTAAGAATGAAGGTGTTGTACTAATAGAAACTAAGTACAGAAAATTTCAGTT
TTAGGTGGTTGTAGCTGATGAGTTATTACCTCATAGAGACTATAATATTCTATTTGGTAT
TATATTATTTGATGTTTGCTGTTCTTCAAACATTTAAATCAAGCTTTGGACTAATTATGC
TAATTTGTGAGTTCTGATCACTTTTGAGCTCTGAAGCTTTGAATCATTCAGTGGTGGAGA
TGGCCTTCTGGTAACTGAATATTACCTTCTGTAGGAAAAGGTGGAAAATAAGCATCTAGA
AGGTTGTTGTGAATGACTCTGTGCTGGCAAAAATGCTTGAAACCTCTATATTTCTTTCGT
TCATAAGAGGTAAAGGTCAAATTTTTCAACAAAAGTCTTTTAATAACAAAAGCATGCAGT
TCTCTGTGAAATCTCAAATATTGTTGTAATAGTCTGTTTCAATCTTAAAAAGAATCA

FIGURE 326

MAAACGPGAAGYCLLLGLHLFLLTAGPALGWNDPDRMLLRDVKALTLHYDRYTTSRRLDP
IPQLKCVGGTAGCDSYTPKVIQCQNKGWDGYDVQWECKTDLDIAYKFGKTVVSCEGYESS
EDQYVLRGSCGLEYNLDYTELGLQKLKESGKQHGFASFSDYYYKWSSADSCNMSGLITIV
VLLGIAFVVYKLFLSDGQYSPPPYSEYPPFSHRYQRFTNSAGPPPPGFKSEFTGPQNTGH
GATSGFGSAFTGQQGYENSGPGFWTGLGTGGILGYLFGSNRAATPFSDSWYYPSYPPSYP
GTWNRAYSPLHGGSGSYSVCSNSDTKTRTASGYGGTRRR

Signal peptide:
amino acids 1-30

Transmembrane domain:
amino acids 171-190

N-glycosylation site:
amino acids 172-176

Glycosaminoglycan attachment sites:
amino acids 244-248, 259-263, 331-335

Tyrosine kinase phosphorylation site:
amino acids 98-106

N-myristoylation sites:
amino acids 68-74, 69-75, 131-137, 241-247, 247-253, 266-272, 270-276, 278-284, 312-318

FIGURE 327

GGCACGAGGTGGAAGGGCTTTTACAAACAGATTGCTGGCCCCACCCCCCAGAATTTCTCA
TCAGGAGTGGGCAAGACCAATCATTTGCATTTCTGACAAGTTCCCAGGAGCTGCAGCTGC
TGGCCCTGGAACCACACTTTGAGAACCACTGCTTTAGACCAAACACCAAAGGAAGATGCA
GCCACCCTCCTTTACATGTCACAACGCTCAGGGTCCATGAGTACCTCAGGCTGTCCAGCT
GAGCTCCACCTGCAGCAGCCGAGATTCCCGACTCGCTCCACCATTGGGGGCTAGGAGTGA
AGCGTGTCACCATGGTCAGCTCATGGCCAGCCAGGAAAGCCTCTCTGCTGTGCGTCTGTG
CAGTTCTTGTTCTTCCCTGGAGGACTCTTGGATCGCCTGTGATCTTGGCCAGGAGACCAG
GTGCCTGGGTCCCTTCCTGGAAGGGGACAAGTTACACACCCCAGCCCCATTTTCCCACCA
ACTTCTACATGCCTTGGGAGAACCTTCTACATGTTGGCTGCCCCCTTCCCCTATTTCAGC
AGTGCCCAGTCCTGCTTATAAACCTGAGGCCTGCTCCCCATACCTTCCCTGTGCAAGTGC
CAGCCGTTATTCCAGGCAGCCCAATGTTGTTGAGGCCAGATGGATTCCTGGAAGCAGCTG
GCCCATGGATGTGAGTCATCACAGTATTCTAGAAACAGAGAAGAGGTCTTAACCTAATGC
GCATAGAGAAATTGTTCTCATTGTAAACATACCCCTGTCCTTAGCTGATCTAGGTGGAAG
CCCAGCTTCATGTGCTAGGGGCATGATAATGATAATAAAGGAATTGTATCTAGGACTAA

FIGURE 328

MVSSWPARKASLLCVCAVLVLPWRTLGSPVILARRPGAWVPSWKGTSYTPQPHFPTNFYM
PWENLLHVGCPLPLFQQCPVLLINLRPAPHTFPVQVPAVIPGSPMLLRPDGFLEAAGPWM

Signal peptide:
amino acids 1-27 cAMP- and cGMP-dependent protein kinase phosphorylation site:
amino acids 8-12

FIGURE 329

CAAAGAGTAGTCAGTCCCTTCTTGGCTCTGCTGACACTCGAGCCCACATTCCATCACCTG
CTCCCAATCATGCAGGTCTCCACTGCTGCCCTTGCCGTCCTCCTCTGCACCATGGCTCTC
TGCAACCAGGTCCTCTCTGCACCACTTGCTGCTGACACGCCGACCGCCTGCTGCTTCAGC
TACACCTCCCGACAGATTCCACAGAATTTCATAGCTGACTACTTTGAGACGAGCAGCCAG
TGCTCCAAGCCCAGTGTCATCTTCCTAACCAAGAGAGGCCGGCAGGTCTGTGCTGACCCC
AGTGAGGAGTGGGTCCAGAAATACGTCAGTGACCTGGAGCTGAGTGCCTGAGGGGTCCAG
AAGCTTCGAGGCCCAGCGACCTCAGTGGGCCCAGTGGGGAGGAGCAGGAGCCTGAGCCTT
GGGAACATGCGTGTGACCTCTACAGCTACCTCTTCTATGGACTGGTTATTGCCAAACAGC
CACACTGTGGGACTCTTCTTAACTTAAATTTTAATTTATTTATACTATTTAGTTTTTATA
ATTTATTTTTGATTTCACAGTGTGTTTGTGATTGTTTGCTCTGAGAGTTCCCCCTGTCCC
CTCCCCCTTCCCTCACAGTGTGTCTGGTGACAACCGAGTGGCTGTCATCGGCCTGTGTAG
GCAGTCATGGCACCAAAGCCACCAGACTGACAAATGTGTATCAAATGCTTTTGTTCAGGG
CTGTGATCGGCCTGGGGAAATAATAAAGATGTTCTTTTAAACGGTAAAAAA

FIGURE 330

MQVSTAALAVLLCTMALCNQVLSAPLAADTPTACCFSYTSRQIPQNFIADYFETSSQCSK
PSVIFLTKRGRQVCADPSEEWVQKYVSDLELSA

Signal sequence:
1-23

Small cytokines (intercrine/chemokine) C-C subfamily
signature:
1-35, 2-36, 10-44, 34-74, 50-90

Small cytokines (intecrine/chemokine):
24-89

FIGURE 331

```
GGCACGAGGTGAGACTTTAAATGAAATGTCTCACAAGCTAGGTGATCCAGGTTTTGTGGT
CTTTGCAACCCTTGTGGTCATTGTGGCCTTGATATTAATCTTCGTGGTGGGTCCTCGCCA
TGGACAGACAAACATTCTTGTGTACATAACAATCTGCTCTGTAATCGGCGCGTTTTCAGT
CTCCTGTGTGAAGGGCCTGGGCATTGCTATCAAGGAGCTGTTTGCAGGGAAGCCTGTGCT
GCGGCATCCCCTGGCTTGGATTCTGCTGCTGAGCCTCATCGTCTGTGTGAGCACACAGAT
TAATTACCTAAATAGGGCCCTGGATATATTCAACACTTCCATTGTGACTCCAATATATTA
TGTATTCTTTACAACATCAGTTTTAACTTGTTCAGCTATTCTTTTTAAGGAGTGGCAAGA
TATGCCTGTTGACGATGTCATTGGTACTTTGAGTGGCTTCTTTACAATCATTGTGGGGAT
ATTCTTGTTGCATGCCTTTAAAGACGTCAGCTTTAGTCTAGCAAGTCTGCCTGTGTCTTT
TCGAAAAGACGAGAAAGCAATGAATGGCAATCTCTCTAATATGTATGAAGTTCTTAATAA
TAATGAAGAAAGCTTAACCTGTGGAATCGAACAACACACTGGTGAAAATGTCTCCCGAAG
AAATGGAAATCTGACAGCTTTTTAAGAAAGGTGTAATTAAAGGTTAATCTGTGATTGTTA
TGAAGTGAATTTGAATATCATCAGAATGTGTCTGAAAAACATTGTCCTCAAATAATGTT
CTTTAAAGGCAATCTTTTAAAGATTTCACTAATTTGGACCAAGAAATTACTTTTCTTGT
ATTTAAACAAACAATGGTAGCTCACTAAAATGACCTCAGCACATGACGATTTCTATTAAC
ATTTTATTGTTGTAGAAGTATTTTACATTTTCATCCCTTCTCCAAAAGCCGAATGCACTA
ATGACAGTTTTAAGTCTATGAAAATGCTTTATTTTTTCATTGGTGATGAAAGTCTGAAAT
GTGCATTTGTCATCCCCACTCCATCAATCCCTGACCATGTAAGGCTTTTTTATTTTAAAA
AAACAGAGTTATCCCAATACATTATCCTGTGATTTACCTTACCTACAAAAGTGGCTCCTG
TTTGTTTGATGATGATTGGTTTTATTTTTGAAATATTTATTAAGGGAAAACTAAGTTACT
GAATGAAGGAACCTCTTTCTTACAAAACAAAAAAAGGGCAGAAATCACCCCAAGGAACG
ATTTCTCAGGTTGAGATGATCACCGTGAATCCGGCTTCCTCTGAGCATTCGATGGCCTTA
GCACCTCATCAAGCCAGCACATCCTGCCTGCTGTTGCAGCCTGGCTGGGTTTATTCTTCA
GTTACCCTAATCCCATGATGCCTGGAACCTTGATTACCGTTTTACATCAGCTCTTGTACT
TTTCAGTATATTTTCATAATGAGTTATATTGTCATTTAGACTTTGAACAGCTCTGGGAAA
TAGAAGACTAGGGTTGTTTCTTAAATTTAGCTCATGTTATAATAAAAGTTGAAATG
```

FIGURE 332

```
MSHKLGDPGFVVFATLVVIVALILIFVVGPRHGQTNILVYITICSVIGAFSVSCVKGLGI
AIKELFAGKPVLRHPLAWILLLSLIVCVSTQINYLNRALDIFNTSIVTPIYYVFFTTSVL
TCSAILFKEWQDMPVDDVIGTLSGFFTIIVGIFLLHAFKDVSFSLASLPVSFRKDEKAMN
GNLSNMYEVLNNNEESLTCGIEQHTGENVSRRNGNLTAF
```

Signal sequence:
1-33

Transmembrane domain:
40-60, 70-90, 103-123, 139-159

N-glycosylation site:
103-106, 182-185, 208-211, 215-218

N-myristoylation site:
57-62, 140-145, 181-186, 214-219

FIGURE 333

GTG<u>ATG</u>GCGGCTGGTGATGGGGACGTGAAGCTAGGCACCCTGGGGAGTGGCAGCGAGAGC
AGCAACGACGGCGGCAGCGAGAGTCCAGGCGACGCGGGAGCGGCAGCGGAAGGGGGAGGC
TGGGCGGCGGCGGCGTTGGCGCTTCTGACGGGGGGCGGGGAAATGCTGCTGAACGTGGCG
CTGGTGGCTCTGGTGCTGCTGGGGGCCTACCGGCTGTGGGTGCGCTGGGGCGGCGGGGT
CTGGGGGCCGGGGCCGGGGCGGGCGAGGAGAGCCCCGCCACCTCTCTGCCTCGCATGAAG
AAGCGGGACTTCAGCTTGGAGCAGCTGCGCCAGTACGACGGCTCCCGCAACCCGCGCATC
CTGCTCGCGGTCAATGGGAAAGTCTTCGACGTGACCAAAGGCAGCAAGTTCTACGGCCCG
GCGGGTCCATATGGAATATTTGCTGGTAGGGATGCCTCCAGAGGACTGGCCACATTTTGC
CTAGATAAAGATGCACTTAGAGATGAATATGATGATCTCTCAGATTTGAATGCAGTACAA
ATGGAGAGTGTTCGAGAATGGGAAATGCAGTTTAAAGAAAAATATGATTATGTAGGCAGA
CTCCTAAAACCAGGAGAAGAACCATCAGAATATACAGATGAAGAAGATACCAAGGATCAC
AATAAACAGGAT<u>TGA</u>ACTTTGTAAACAACCAAAGTCAGGGGCCTTCAGAACTGCAATTCT
TACTCCCTTTCACAGACTGTCCGGAGTCTTTGGGTTTGATTCACCTGCTGCGAAAAACAT
TCAACAAATTGTGTACAAGATAAATTAATCTCACTATGAAGATTTGAATAACTAGACATT
ATTTATGCTGCCAAACTCATTTGTTGCAGTTGTTTGTAATGTCTAGTGGGCTTCATCAT
CCTGAAAAGAAGGAGACAGGGATTTTTTTAAAGAGCAAGAAAGTCACAATATTACTTCTT
TCCTTCCTTTTTCCTTCTTTCCTTTCTTCTTTCTCTTTCTTTCTTTTTAAAATATATTG
AAGACAACCAGATATGTATTTGCTACTCAAGTGTACAGATCCTCAAGAAACATCAGG
G

FIGURE 334

MAAGDGDVKLGTLGSGSESSNDGGSESPGDAGAAAEGGGWAAAALALLTGGGEMLLNVAL
VALVLLGAYRLWVRWGRRGLGAGAGAGEESPATSLPRMKKRDFSLEQLRQYDGSRNPRIL
LAVNGKVFDVTKGSKFYGPAGPYGIFAGRDASRGLATFCLDKDALRDEYDDLSDLNAVQM
ESVREWEMQFKEKYDYVGRLLKPGEEPSEYTDEEDTKDHNKQD

Signal sequence:
None

Transmembrane domain:
45-65

Tyrosine kinase phosphorylation site:
202-210

N-myristoylation site:
11-16, 16-21, 37-42, 38-43, 79-84, 81-86, 83-88, 144-149

Amidation site:
75-78

FIGURE 335

```
GACAGGCCGGGGTTACTGTGGCGACCACGAGAGCAGCTTTGGCGCTATGGAGGAGCCCGG
GGCTACCCCTCAACCGTATTTGGGGCTGCTCCTGGAGGAGCTACGCAGGGTTGTGGCAGC
ACTGCCTGAAGGTATGAGACCAGATTCTAATCTTTATGGTTTTCCATGGGAATTGGTGAT
ATGTGCAGCTGTTGTTGGATTTTTTGCTGTTCTCTTTTTTTTGTGGAGAAGTTTTAGATC
GGTTAGGAGTCGGCTTTATGTGGGACGAGAGAAAAGCTTGCTCTAATGCTTTCTGGACT
AATTGAAGAAAAAGTAAACTACTTGAAAAATTTAGCCTTGTTCAAAAGAGTATGAAGG
CTATGAAGTAGAGTCATCTTTAAAGGATGCCAGCTTTGAGAAGGAGGCAACAGAAGCACA
AAGTTTGGAGGCAACCTGTGAAAAGCTGAACAGGTCCAATTCTGAACTTGAGGATGAAAT
ACTCTGTCTAGAAAAGAGTTAAAAGAAGAGAAATCCAAACATTCTGAACAAGATGAATT
GATGGCGGATATTTCAAAAGGATACAGTCTCTAGAAGATGAGTCAAAATCCCTCAAATC
ACAAGTAGCTGAAGCCAAAATGACCTTCCAGATATTTCAAATGAATGAAGAACGACTGAA
GATAGCAATAAAAGATGCTTTGAATGAAAATTCTCAACTTCAGGAAAGCCAGAAACAGCT
TTTGCAAGAAGCTGAAGTATGGAAAGAACAAGTGAGTGAACTTAATAAACAGAAAGTAAC
ATTTGAAGACTCCAAAGTACATGCAGAACAAGTTCTAAATGATAAAGAAAGTCACATCAA
GACTCTGACTGAACGCTTGTTAAAGATGAAAGATTGGGCTGCTATGCTTGGAGAAGACAT
AACGGATGATGATAACTTGGAATTAGAAATGAACAGTGAATCGGAAAATGGTGCTTACTT
AGATAATCCTCCAAAAGGAGCTTTGAAGAAACTGATTCATGCTGCTAAGTTAAATGCTTC
TTTAAAAACCTTAGAAGGAGAAAGAAACCAAATTTATATTCAGTTGTCTGAAGTTGATAA
AACAAAGGAAGAGCTTACAGAGCATATTAAAAATCTTCAGACTCAACAAGCATCTTTGCA
GTCAGAAAACACACATTTTGAAAATGAGAATCAGAAGCTTCAACAGAAACTTAAAGTAAT
GACTGAATTATATCAAGAAATGAAATGAAACTCCACAGGAAATTAACAGTAGAGGAAAA
TTATCGGTTAGAGAAAGAAGAGAAACTTTCTAAAGTAGATGAAAGATCAGCCATGCCAC
TGAAGAGCTGGAGACCTATAGAAAGCGAGCCAAAGATCTTGAAGAAGAATTGGAGAGAAC
TATTCATTCTTATCAAGGGCAGATTATTTCCCATGAGAAAAAGCACATGATAATTGGTT
GGCAGCTCGGAATGCTGAAAGAAACCTCAATGATTTAAGGAAAGAAAATGCTCACAACAG
ACAAAAATTAACTGAAACAGAGCTTAAATTTGAACTTTTAGAAAAAGATCCTTATGCACT
CGATGTTCCAAATACAGCATTTGGCAGAGGCTCACGAGGCCCAGGGAATCCTCTGGACCA
TCAGATTACCAATGAAAGAGGAGAATCAAGCTGTGATAGGTTAACCGATCCTCATAGGGC
TCCCTCTGACACTGGGTCTCTGTCACCTCCATGGGACCAGGACCGTAGGATGATGTTTCC
TCCGCCAGGACAATCATATCCTGATTCAGCCCTTCCTCCACAAAGGCAAGACAGATTTTG
TTCTAATTCTGGTAGACTGTCTGGACCAGCAGAACTCAGAAGTTTTAATATGCCTTCTTT
GGATAAAATGGATGGGTCAATGCCTTCAGAAATGGAATCCAGTAGAAATGATACCAAAGA
TGATCTTGGTAATTTAAATGTGCCTGATTCATCTCTCCCTGCTGAAAATGAAGCCACTGG
CCCTGGCTTTGTTCCTCCACCTCTTGCTCCAATCAGAGGTCCATTGTTTCCAGTGGATGC
AAGAGGCCCATTCTTGAGAAGAGGACCTCCTTTCCCCCCACCTCCTCCAGGAGCCATGTT
TGGAGCTTCTCGAGATTATTTTCCACCAAGGGATTTCCCAGGTCCACCACCTGCTCCATT
TGCAATGAGAAATGTCTATCCACCGAGGGGTTTTCCTCCTTACCTTCCCCCAAGACCTGG
ATTTTTCCCCCCACCCCACATTCTGAAGGTAGAAGTGAGTTCCCCTCAGGTTTGATTCC
ACCTTCAAATGAGCCTGCTACTGAACATCCAGAACCACAGCAAGAAACCTGACAATATTT
TTGCTCTCTTCAAAAGTAATTTGACTGATCTCATTTTCAGTTTAAGTAACTGCTGTTAC
TTAAGTGATTACACTTTTGCTCAAATTGAAGCTTAATGGAATTATAATTCTCAGGATAGT
ATTTGTAAATAAAGATGATTTAAATATGAATCTTATGAGTAAATTATTTCAATTTTATT
TTAGACGGTATAACTATTTCAATTTGATTAATCCACTATTATATAAACAATAGTGGGAGT
TTTATATATGTAATCTTTCAGGTGGGGAGGCTTTAAATTCTGAAGTCTGTGTCTTTATGC
CAAGAACTGTATTTACTGTGGTTGTGGACAAATGTGAAGTAACTTTATGCTTAAATAAA
TTATAGTTGATTTAAAGATTTGTTTGGCATTGATAATAATAAAATCAGTAGTTTTTCTAT
AAAAAAAAAAAAAAAAAAAAAAAAAAAAAAAAAAAAAAAAAAAAAAAAAAAA
```

FIGURE 336

```
TGRGYCGDHESSFGAMEEPGATPQPYLGLLLEELRRVVAALPEGMRPDSNLYGFPWELVI
CAAVVGFFAVLFFLWRSFRSVRSRLYVGREKKLALMLSGLIEEKSKLLEKFSLVQKEYEG
YEVESSLKDASFEKEATEAQSLEATCEKLNRSNSELEDEILCLEKELKEEKSKHSEQDEL
MADISKRIQSLEDESKSLKSQVAEAKMTFQIFQMNEERLKIAIKDALNENSQLQESQKQL
LQEAEVWKEQVSELNKQKVTFEDSKVHAEQVLNDKESHIKTLTERLLKMKDWAAMLGEDI
TDDDNLELEMNSESENGAYLDNPPKGALKKLIHAAKLNASLKTLEGERNQIYIQLSEVDK
TKEELTEHIKNLQTQQASLQSENTHFENENQKLQQKLKVMTELYQENEMKLHRKLTVEEN
YRLEKEEKLSKVDEKISHATEELETYRKRAKDLEEELERTIHSYQGQIISHEKKAHDNWL
AARNAERNLNDLRKENAHNRQKLTETELKFELLEKDPYALDVPNTAFGRGSRGPGNPLDH
QITNERGESSCDRLTDPHRAPSDTGSLSPPWDQDRRMMFPPPGQSYPDSALPPQRQDRFC
SNSGRLSGPAELRSFNMPSLDKMDGSMPSEMESSRNDTKDDLGNLNVPDSSLPAENEATG
PGFVPPPLAPIRGPLFPVDARGPFLRRGPPFPPPPPGAMFGASRDYFPPRDFPGPPPAPF
AMRNVYPPRGFPPYLPPRPGFFPPPPHSEGRSEFPSGLIPPSNEPATEHPEPQQET
```

Signal sequence:
None

Transmembrane domain:
54-74

N-glycosylation site:
150-153, 338-341, 636-639 cAMP- and cGMP-dependent protein kinase phosphorylation site:
413-416

Tyrosine kinase phosphorylation site:
414-421

N-myristoylation site:
466-417, 625-630, 697-702

Leucine zipper pattern:
142-163

FIGURE 337

```
GGACTGCGGTCTCGGGCAGCAATGGCCGAGAAGCGCGACACACGGGACTCCGAAGCCCAG
CGGCTCCCCGACTCCTTCAAGGACAGCCCCAGTAAGGGCCTTGGACCTTGCGGATGGATT
TTGGTGGCGTTCTCATTCTTATTCACCGTTATAACTTTCCCAATCTCAATATGGATGTGC
ATAAAGATTATAAAAGAGTATGAAAGAGCCATCATCTTTAGATTGGGTCGCATTTTACAA
GGAGGAGCCAAAGGACCTGGTTTGTTTTTTATTCTGCCATGCACTGACAGCTTCATCAAA
GTGGACATGAGAACTATTTCATTTGATATTCCTCCTCAGGAGATCCTGACAAGGATTCA
GTGACAATTAGCGTGGATGGTGTGGTCTATTACCGCGTTCAGAATGCAACCCTGGCTGTG
GCAAATATCACCAACGCTGACTCAGCAACCCGTCTTTTGGCACAAACTACTCTGAGGAAT
GTTCTGGGCACCAAGAATCTTTCTCAGATCCTCTCTGACAGAGAAGAAATTGCACACAAC
ATGCAGTCTACTCTGGATGATGCCACTGATGCCTGGGGAATAAAGGTGGAGCGTGTGGAA
ATTAAGGATGTGAAACTACCTGTGCAGCTCCAGAGAGCTATGGCTGCAGAAGCAGAAGCG
TCCCGCGAGGCCCGCGCCAAGGTTATTGCAGCCGAAGGAGAAATGAATGCATCCAGGGCT
CTGAAAGAAGCCTCCATGGTCATCACTGAATCTCCTGCAGCCCTTCAGCTCCGATACCTG
CAGACACTGACCACCATTGCTGCTGAGAAAAACTCAACAATTGTCTTCCCTCTGCCCATA
GATATGCTGCAAGGAATCATAGGGGCAAAACACAGCCATCTAGGCTAGTGTAGAGATGAG
CGCTAGCCTTCCAAGCATGAAGTCGGGGACCAAATTAGCCTTTAACTCATAAAGAGAGGG
TAGGGCTTTTCTTTTTCCATATGTCAATTGTGGTGTTCCCAGAATGTATAGCAGTTATAA
AAATAGGTGAAAGAATTGTTAGCTTGTAAATACTGAGAGATTGGTGATTTATATAAGGTA
ATCTGTTAGTCTTAAAATAGTTAAAAGTTTGTATTTTTAGATTATTATGTAGTAGGTTAG
ATCCCTCTTGTTTTGACTTCCACTGACTCATTCTGAACCCCCTAAGCACCCAGGCCACAG
GCAAGAACCTGGGCTGTAACTGCCACCTGACACCGCTGACTGGCTAAATGCTTTGCAGAA
AGTGATGACCTTACACCACAACCAGCTTCTCCAGGTCATATGTGCCTTACCTCCAGAAGT
CTTTTTTTTTTTTTTTTCTGAGATGGAGTTTCACTCTTGTTGCCCAGGCTGGAGTGCAA
TAGCATGATCTCGGCTCACTGCAACCTCCGCCTCCTGGGTTCAAGAGATTCTCCTGCCTC
AGCCTCCCCAGTAGCTGGGATTACAGGCTCATGCCACCATGCCCAGCTAATTTTTGTATT
ATTATTATTGTTTTTAGTAGAGACGGGGTTTCACCATGTTGGCCAGGCTAGTCACGAAC
TCCTAACCTCAGGTGATCCACCCACCTCTGCCTCCAAAGTGCTGGATTACAGGCTGAGCT
ACCACCCTGGTTTGGAGAGTCTTAATTAATTGAAATTTCCCTAATGTTCATTTATTTTCT
AAATCCAGCCGTGTTTCAGAATAATCCTTACTTGAGAGTAGCCATTTTCTTGTGTACTTG
TCAGAACTAGAGGAAATAGCCAAGACTAATGAAAACATTACTCTAACCCTTAAAAGACT
TTTAAATTCACTACTAGAGTGGTCATTTTAAAAATACATCCATGTTTAACTTATTTTGA
GCCTTTCTTTTATGAGTAAATGATTCCTCCTTGTTCTGTCTTTCAAACCAGCTAAATATT
TGTCACAAAAGTGACTTTTTTCTCACTGTTGCCTATTTTCATATATCAGGTTTTAAATAG
TTTTAATTTTTTAATAAAATTTTTCTCTACGTTCTATATGCAATTGTTATATATCTATTT
GAATAGCTGAAGGACTAAAATACTTTTTAAGAGATAACTTCAGGAACCATTATATTTT
ACTATCTGCATGCTGTTAACTGTGGTACACTGTGAAATATGTTGATTACAAACCCATTCA
TTACATAGTATAAGGAATTCACAGTATATTGACTATATAGTGTCTAATGACTGGGCAGAT
ACTGTCAACTTACAATATCTATATAGAGAGGCTTTAAACTTACCTTACTCATTCTCTATG
ATGTATGACTTGATGCTGAAGAGGAAGCTGGTCAGCTCCTCATGGACAACAAATTCTTA
GTCTATAATATTAGGAGACATCTCTAGTTTTGCAAATGTCTGTGAATCTGAGCAACCTGG
ACTTCTGCTTACTGGCCAGAAAGCTGGCGGGTGACATTTGTAACATTCCTCTTTGAGAC
TCTGAGTTCACCTAGAGAAGTCTAAGCATAACAGCTTTCTTTCCCAGCACGAGCCTTTAT
AGCTCTCTTTAGCTCAACCACTCTGTCCATCCAGCCAATGGATGTCCTTCCCTGTACCCA
ATTCAAGCTTATTTTAGGGAAGCCTTGAAACTACCATGTATCTGGCTCTAGCTGAGTTAT
TGAGGATTGAGCCAGTGCAACGTTAAACTCAGTGCACTTACATTTGATTTAAATGATGGT
TTTATCTGTTGTGTGAAGTGGTTCACCCTTGAGGACCAGGAGCCTCCATATCCTGACTGA
AAACCTTTTCTGAGACTTAGAGTAACAGTACTTTTGGTTCCTTGAGTTCTCCTGTCTCCA
GATACCTAAATGACCTTGACTTTTCTGCCTTGTGAATTCGTAGTCCAATCAGCTGAAATT
AAATCACTTGGGAGGGACGCATAGAAGGAGCTCTAGGAACACAGTGCCAGTGCAGAAGTT
TCTCCAGGTGGCCTCCCTTTCCAACAATGTACATAATAAAGTGTATGCACTTTCACT
```

FIGURE 338

```
MAEKRDTRDSEAQRLPDSFKDSPSKGLGPCGWILVAFSFLFTVITFPISIWMCIKIIKEY
ERAIIFRLGRILQGGAKGPGLFFILPCTDSFIKVDMRTISFDIPPQEILTKDSVTISVDG
VVYYRVQNATLAVANITNADSATRLLAQTTLRNVLGTKNLSQILSDREEIAHNMQSTLDD
ATDAWGIKVERVEIKDVKLPVQLQRAMAAEAEASREARAKVIAAEGEMNASRALKEASMV
ITESPAALQLRYLQTLTTIAAEKNSTIVFPLPIDMLQGIIGAKHSHLG
```

Signal sequence:
1-45

Transmembrane domain:
None

N-glycosylation site:
128-131, 135-138, 159-162, 229-232, 264-267 cAMP- and cGMP-dependent protein kinase phosphorylation site:
4-7

N-myristoylation site:
26-31, 278-283, 281-286

SPFH domain/Band 7 family:
39-230

FIGURE 339

```
TCTAGAGCCCTCTCCCAACATGGCGGCCTCAGCAAAAAAGAAGAATAAGAAGGGGAAGAC
TATCTCCCTAACAGACTTTCTGGCTGAGGATGGGGGTACTGGTGGAGGAAGCACCTATGT
TTCCAAACCAGTCAGCTGGGCTGATGAAACGGATGACCTGGAAGGAGATGTTTCGACCAC
TTGGCACAGTAACGATGACGATGTGTATAGGGCGCCTCCAATTGACCGTTCCATCCTTCC
CACTGCTCCACGGGCTGCTCGGGAACCCAATATCGACCGGAGCCGTCTTCCCAAATCGCC
ACCCTACACTGCTTTTCTAGGAAACCTACCCTATGATGTTACAGAAGAGTCAATTAAGGA
ATTCTTTCGAGGATTAAATATCAGTGCAGTGCGTTTACCACGTGAACCCAGCAATCCAGA
GAGGTTGAAAGGTTTTGGTTATGCTGAATTTGAGGACCTGGATTCCCTGCTCAGTGCCCT
GAGTCTCAATGAAGAGTCTCTAGGTAACAGGAGAATTCGAGTGGACGTTGCTGATCAAGC
ACAGGATAAAGACAGGGATGATCGTTCTTTTGGCCGTGATAGAAATCGGGATTCTGACAA
AACAGATACAGACTGGAGGGCTCGTCCTGCTACAGACAGCTTTGATGACTACCACCTAG
AAGAGGTGATGATAGCTTTGGAGACAAGTATCGAGATCGTTATGATTCAGACCGGTATCG
GGATGGGTATCGGGATGGGTATCGGGATGGCCCACGCCGGGATATGGATCGATATGGTGG
CCGGGATCGCTATGATGACCGAGGCAGCAGAGACTATGATAGAGGCTATGATTCCCGGAT
AGGCAGTGGCAGAAGAGCATTTGGCAGTGGGTATCGCAGGGATGATGACTACAGAGGAGG
CGGGGACCGCTATGAAGACCGATATGACAGACGGGATGATCGGTCGTGGAGCTCCAGAGA
TGATTACTCTCGGGATGATTATAGGCGTGATGATAGAGGTCCCCCCAAAGACCCAAACT
GAATCTAAAGCCTCGGAGTACTCCTGAAGAAGATGATTCCTCTGCTAGTACCTCCCAGTC
CACTCGAGCTGCTTCTATCTTTGGAGGGGCAAAGCCTGTTGACACAGCTGCTAGAGAAAG
AGAAGTAGAAGAACGGCTACAGAAGGAACAAGAGAAGTTGCAGCGTCAGTGGAATGAGCC
AAAACTAGAACGACGGCCTCGGGAGAGACACCCAAGCTGGCGAAGTGAAGAAACTCAGGA
ACGGGAACGGTCGAGGACAGGAAGTGAGTCATCACAAACTGGGACCTCCACCACATCTAG
CAGAAATGCACGAAGGAGAGAGAGTGAGAAGTCTCTAGAAAATGAAACACTCAATAAGGA
GGAAGATTGCCACTCTCCAACTTCTAAACCTCCCAAACCTGATCAGCCCCTAAAGGTAAT
GCCAGCCCCTCCACCAAAGGAGAATGCTTGGGTGAAGCGAAGTTCTAACCCTCCTGCTCG
ATCTCAGAGCTCAGACACAGAGCAGCAGTCCCCTACAAGTGGTGGGGAAAAGTAGCTCC
AGCTCAACCATCTGAGGAAGGACCAGGAAGGAAAGATGAAAATAAAGTAGATGGGATGAA
TGCCCCAAAAGGCCAAACTGGGAACTCTAGCCGTGGTCCAGGAGACGGAGGGAACAGAGA
CCACTGGAAGGAGTCAGATAGGAAAGATGGCAAAAAGGATCAAGACTCCAGATCTGCACC
TGAGCCAAAGAAACCTGAGGAAAATCCAGCTTCTAAGTTCAGTTCTGCAAGCAAGTATGC
TGCTCTCTCTGTTGATGGTGAAGATGAAAATGAGGGAGAAGATTATGCCGAATAGACCTC
TACATCCTGTGCTTTTCTCCTAGTTTCTCTCCACCCTGGAACATTCGAGAGCAAATCAAA
ACCTCTATCCAGACAAGACAAAATAAAACTCAACATCTCCTGAAGACCTTTCTTACCTTT
TTTTAAAAACAAAAAXTGAAATTATTTTGCATGCTGCTGCAGCCTTTAAAGTATTGAAGT
AACTGGAGAATTGCCAATACAGCCAGAGAGAAAGGGACTACAGCTTTTTAGAGGAAAAGT
TGTGGTGCGTTATGTCACCATGCAGTTGCCAGTGTGATTAGTGCCTAGGGGTCTCATTTA
GCAGAAATGGTAATGACAGTGATATAATGCCTGGAACCTGGTTGGGCAGTAGGGGAGGGA
GGTAGAAGGAAAGTGTGAGATTTCTACCTTTTAGTTTTCATCCTATTGTGGCATATATG
AATTCTCAAACATTATCTGAATAAATTTTCCACTCTTGGAAAGGTAGATTTAGCCTCAAG
TTGTTCTAGTCTCCAGGAGGCTGCCAGCCCCTCCTCTTATTTAATTCTGAGTTTTGGGGG
CCAGCCTAGAGGGAATTCCTTTTTTTTTTTTTTAACCCCCAGGGGGGTAGTTGGGAGT
GAGACTATAGGCCATAAAGAATGGGACTGCATTGGACCAAAATAAATGGGAAATCGTGG
TTTGAAAAGAAGCTTTTGGGAAGTGATGAGTCATTTTGCACCAGGTAATAGGGAAATT
GTGTGACCTCCAGCAAACACATGAATGGTTATTTCCTGGAGCCGGAAGCACTTGGGGGTC
GTGGTAATTCCCAGTGTTTTCTGTGTCCTAGTTTTACCCTTTCTAAACACTGTCCTTTTT
GAAAGTTTTGAATATATCCACATTCTATTGAAACCTTGAAACTAAAAATTTAGACTCTTA
TCGTCATCTTAAGTTCTTCATGCTACTCTTAACCTCCCAAAAGCAGTATCTAAGTCACA
TACATGATGTCTTGGGCATTTTCTGAGCCATGGAGAACTCTGAAAGGAAGAATCGCTGCT
TTTCTCAAGCAAATCGGTTTCTTGATGTCTTTTGGTTCTCCTTGCCTGCTCCTGATGCTT
```

FIGURE 339
(continued)

```
GGACCCCTTTTATTGATCAGAGTGCTCTAGAATAATGGATGGTCTTGGATGATGGATAAA
TAGGGACAGGGACAGTTAAATTGGGAGCCTTTCTTACAACCTTGATGGGATTTTTCCCCC
CAAGTTTCCTTCTCCACTGAAATGCCACACTAATGCTTGTTGGATTCATGAGGTGGCCAG
ACCAATGTGTTGTTTTGTTGTTGTTTTTTTTTTAAGCTTCCCTTGAGAGAATAAATGGTA
ATGGAGAGAATCATTTAACAAGGTCCTGGTTTCTCTTGCAACACAGTAGCTAAACTTGCC
TGCTTTTATATGCATTTTTGTAGGGATCAGCTTGGTAGACAGTATTAGCGGAGAAACACC
TTGATCTTGGTTTGCAAGCCCTTCTCCCATCAGTCCTAGATTAGGCCCTGTTCAGCCATG
CAGGGGTGTTGGTTTATGCGTGCTGCAGCAGTGGGCATAATGAATATAATTTACCCAGTG
GACAAAGGTGTGTACCAAGTGAATTTAAATAATTGGTGTGGATTGGCCAGTAGCTAAGAA
GTGGGCTTTTAAAGAGTATTGAAGATTGAAAGGGTTTTTCTTTCTTTTTAAAAAAGAAA
AACAAACTATTGATTGTAGATAATGAAAAGCTAGGGTTTGCCCTCTTCATGTCTACTCTC
CTTCCAAATAGTTATATCCAAAACTGTTTTTCCCTCTCCCCTACCTTGTCCCCCCTATTA
AAATAGAAACAGGGATTGATTAATGTCCCGCTCCTGAATACATGTAAAATTTGTACAAAA
ATATCTTCTATGAAAATGATTTGTAATCTGTAGACTTATTACCTGGGAGATGTCTTGATG
TAAAATCCCATCCTTTGGGTTGTGGGTTTTTTGTTTTCTCCAAATAAATCTGATCTTTAA
AGTTAAAAAAAAAAAAAAACTCTAGAGTCGAGGAATTC
```

FIGURE 340

```
MAASAKKKNKKGKTISLTDFLAEDGGTGGGSTYVSKPVSWADETDDLEGDVSTTWHSNDD
DVYRAPPIDRSILPTAPRAAREPNIDRSRLPKSPPYTAFLGNLPYDVTEESIKEFFRGLN
ISAVRLPREPSNPERLKGFGYAEFEDLDSLLSALSLNEESLGNRRIRVDVADQAQDKDRD
DRSFGRDRNRDSDKTDTDWRARPATDSFDDYPPRRGDDSFGDKYRDRYDSDRYRDGYRDG
YRDGPRRDMDRYGGRDRYDDRGSRDYDRGYDSRIGSGRRAFGSGYRRDDDYRGGGDRYED
RYDRRDDRSWSSRDDYSRDDYRRDDRGPPQRPKLNLKPRSTPEEDDSSASTSQSTRAASI
FGGAKPVDTAAREREVEERLQKEQEKLQRQWNEPKLERRPRERHPSWRSEETQERERSRT
GSESSQTGTSTTSSRNARRRESEKSLENETLNKEEDCHSPTSKPPKPDQPLKVMPAPPPK
ENAWVKRSSNPPARSQSSDTEQQSPTSGGGKVAPAQPSEEGPGRKDENKVDGMNAPKGQT
GNSSRGPGDGGNRDHWKESDRKDGKKDQDSRSAPEPKKPEENPASKFSSASKYAALSVDG
EDENEGEDYAE
```

Signal Sequence:
None

Transmembrane domain:
None

N-glycosylation site:
120-123, 448-451, 542-545

Glycosaminoglycan attachment site:
507-510 cAMP- and cGMP-dependent protein kinase phosphorylation site:
439-442, 486-489

Tyrosine kinase phosphorylation site:
225-233, 264-270

N-myristoylation site:
25-30, 26-31, 28-33, 118-123, 421-426, 428-433, 538-543

Amidation site:
276-279, 522-525, 563-566

Cell attachment sequence:
215-217

Eukaryotic putative RNA-binding region RNP-1 signature:
137-144

RNA recognition motif:
98-168

FIGURE 341

GCGTGGACACCACCTCAGCCCACTGAGCAGGAGTCACAGCACGAAGACCAAGCGCAAAGC
GACCCCTGCCCTCCATCCTGACTGCTCCTCCTAAGAGAATGGCACCGGCCAGAGCAGGA
TTCTGCCCCCTTCTGCTGCTTCTGCTGCTGGGGCTGTGGGTGGCAGAGATCCCAGTCAGT
GCCAAGCCCAAGGGCATGACCTCATCACAGTGGTTTAAAATTCAGCACATGCAGCCCAGC
CCTCAAGCATGCAACTCAGCCATGAAAAACATTAACAAGCACACAAAACGGTGCAAAGAC
CTCAACACCTTCCTGCACGAGCCTTTCTCCAGTGTGGCCGCCACCTGCCAGACCCCCAAA
ATAGCCTGCAAGAATGGCGATAAAAACTGCCACCAGAGCCACGGGCCCGTGTCCCTGACC
ATGTGTAAGCTCACCTCAGGGAAGTATCCGAACTGCAGGTACAAAGAGAAGCGACAGAAC
AAGTCTTACGTAGTGGCCTGTAAGCCTCCCCAGAAAAAGGACTCTCAGCAATTCCACCTG
GTTCCTGTACACTTGGACAGAGTCCTTTAGGTTTCCAGACTGGCTTGCTCTTTGGCTGAC
CTTCAATTCCCTCTCCAGGACTCCGCACCACTCCCCTACACCCAGAGCATTCTCTTCCCC
TCATCTCTTGGGGCTGTTCCTGGTTCAGCCTCTGCTGGGAGGCTGAAGCTGACACTCTGG
TGAGCTGAGCTCTAGAGGGATGGCTTTTCATCTTTTTGTTGCTGTTTTCCCAGATGCTTA
TCCCCAAGAAACAGCAAGCTCAGGTCTGTGGGTTCCCTGGTCTATGCCATTGCACATGTC
TCCCCTGCCCCTGGCATTAGGGCAGCATGACAAGGAGAGGAAATAAATGGAAAGGGGGC
AAAAAAAAAAAAAAAAAAAAAAAAAAAAAAAAAAAAAAAAAAAAAAAAAAAAAAAAAAAA
AAAAAAAAAAAAAAAAAAAAAAAAAAAAAAAAAAAA

FIGURE 342

MAPARAGFCPLLLLLLLGLWVAEIPVSAKPKGMTSSQWFKIQHMQPSPQACNSAMKNINK
HTKRCKDLNTFLHEPFSSVAATCQTPKIACKNGDKNCHQSHGPVSLTMCKLTSGKYPNCR
YKEKRQNKSYVVACKPPQKKDSQQFHLVPVHLDRVL

Important features of the protein

Signal peptide:
1-22

Transmembrane domain:
none

N-glycosylation site:
127-131 cAMP- and cGMP-dependent protein kinase phosphorylation site:
139-143

N-myristoylation site:
18-24, 32-38

Pancreatic ribonuclease family signature:
65-72

Pancreatic ribonuclease family proteins:
49-93

FIGURE 343

```
GCATTTGCCACTGGTTGCAGATCAGGCGGACGAGGAGCCGGGAAGGCAGAGCCATGTGGC
TGCCCCCTGCTCTGCTCCTTCTCAGCCTCTCAGGCTGTTTCTCCATCCAAGGCCCAGAGT
CTGTGAGAGCCCCAGAGCAGGGGTCCCTGACGGTTCAATGCCACTATAAGCAAGGATGGG
AGACCTACATTAAGTGGTGGTGCCGAGGGGTGCGCTGGGATACATGCAAGATCCTCATTG
AAACCAGAGGGTCGGAGCAAGGAGAGAAGAGTGACCGTGTGTCCATCAAGGACAATCAGA
AGACCGCACGTTCACTGTGACCATGGAGGGGCTCAGGCGAGATGACGCAGATGTTTACT
GGTGTGGGATTGAAAGAAGAGGACCTGACCTTGGGACTCAAGTGAAAGTGATCGTTGACC
CAGAGGGAGCGGCTTCCACAACAGCAAGCTCACCTACCAACAGCAATATGGCAGTGTTCA
TCGGCTCCCACAAGAGGAACCACTACATGCTCCTGGTATTTGTGAAGGTGCCCATCTTGC
TCATCTTGGTCACTGCCATCCTCTGGTTGAAGGGGTCTCAGAGGGTCCCTGAGGAGCCAG
GGGAACAGCCTATCTACATGAACTTCTCCGAACCTCTGACTAAAGACATGGCCACTTAGA
GAGATGGATCTGCAGAGCCTTCCTGCCCTGGCCACGTTTCCAGAAGAGACTCGGGCTGTG
GAAGGAACATCTACGAGTCCTCGGGATGCAGTGACTGAGATAGGGGCCCTGGGCCTCCGC
CCTGGCCTTGGAGCTGGTGGGCACCTCCCTGTTCTGCACAGCTCAGGGACTTAGCCAGGT
CCTCTCCTGAGCCACCATCACCTCCTGGGGTGCCAGCACCTGTTCTCTTGGTCAGGAGCT
GTAGAGATGGAGCTCAAGCACTGGACGACTCTGTCCCCACTGCTGGAATAACTCGGGCAC
AGAGCATGGGACCAAAGTACAGAAAGAGGTTGGGGGAGACCCCCCAGCCCTAGACTTCC
ATCATTCCGGAGACCAACTCAACACCGTCTTTGCCTGAGAACCTGATATATCCGTGTTTT
TAAATTTTTTTTTTTCTAGCAAAGTTGGGTTTTAATGACTTATGTTCATAGGAAACCTCT
CTGATCCCACACACAAGGAGGGTGATTCTGGGATGAGTTCCTGGTTCTAGGGCATGAGGG
GCTGGATGGACCCTGTCCCCAGGGAGGACATGGCTCTGAGTCCACAGGGCTGAGGAGGCA
ATGGGAACCTCCCTGGCCCGGCCCGGTGCTTGTCCTCCCCCTCCCACCTCTTCCTCCTCC
TAGCTCCCCAAGCTCCCTGCCTATTCCCCCACCTCCGAGGGGCTGCAGCTTGGGAGCCTC
CTCAGCATGACAGCTTGGGTCTCCTCCCCAAAAGAGCCTGTCAGGCCTCAAGAACCACCT
CCAGGTGGGGAGGGCAGTAACGAAAACCATCGCAGGAAATGGCACCCTCCCTTTTCGGTG
ATGTTGAAATCATGTTACTAATGAAAACTGTCCTAGGGAAGTGGTTCTGTCTCCTCACAG
GCTTCACCCACGGCGATGAGGCCCTTGAATGTGGTCACTTTGTGCTGTATGGTTGAGGGA
CCCTCACACCAAAGGGACCTTCCCATGTGAGATGTGCTCCCGCCCCACCTGCCCACAAG
CAAACACACCACACATGTTCGGCATGTTGCCCTTTGAACACCCATGAGGACGCCTCCAAC
CTGCTCTTGGTTCTAATAGGGAGTACTGACTGTCAGCAGTGGATAAAGGAGAGGGACCC
TCTGGTCCCTAGCATGGCACCCAGAGCCTCCCCTCTTCTTGTCCTTCAGCCAAAGAGAAA
CTTTCTCTGACTTTGAACTGAATTTAGGTCTCTGGCCAATGATGGGCCTGAAAATTCCAT
AATGGCCAGAGAGGAGAGTTCGAGCCCGGCTAAGATCCCCTGAGTCATTCTGTGAGGGAC
CAAGACCCACAGTCCACCAGCCCCAGGGCCCTACCTCCTGGAATGCTTTCCTGGATCCAG
CTTCCCGAAGATCCGACCAGACCCAGGGAGGACGGCACCGCTCCGCGGGAGGGAAAGCCA
AAGCATGGTGCTTCACCAGCTGGACTCAGGGGCGAGGGACATGGGCGCTTGTCAACGTG
ATGTCATTCTTTTCCCACCGTTTCTTCCTGTTGATATTCAATGAATCCGTCAATCTCTCT
GGGAAAAAAAAAAAAAAAAAAAAAAAAAAAAAAAAAAAAAAA
```

FIGURE 344

MWLPPALLLLSLSGCFSIQGPESVRAPEQGSLTVQCHYKQGWETYIKWWCRGVRWDTCKI
LIETRGSEQGEKSDRVSIKDNQKDRTFTVTMEGLRRDDADVYWCGIERRGPDLGTQVKVI
VDPEGAASTTASSPTNSNMAVFIGSHKRNHYMLLVFVKVPILLILVTAILWLKGSQRVPE
EPGEQPIYMNFSEPLTKDMAT

Important features of the protein:
Signal peptide:
Amino acids 1-17

Transmembrane domain:
Amino acids 151-170

N-glycosylation site:
Amino acids 190-194

Tyrosine kinase phosphorylation site:
Amino acids 95-103

N-myristoylation sites:
Amino acids 66-72; 125-131

Prokaryotic membrane lipoprotein lipid attachment site:
Amino acids 5-16

FIGURE 345

```
CTGAGCTCCCGGGCTCCGGCAGCGCGCTGGCGGGGCGCCGCATTGCACACTCTGGGGGCG
CCGCAGTGTTCGTGGGATGGGGCAGCGGGCTGCAGCTGGCGGCCGGAATCCGCGCGCAGC
CCGGGTGCAAGTTCTCTCCTGTTGCCCTGAGTGCCCACTCCCAGGCCCTCTGTATGAGTG
ACACTTCAGTCTGCCATGGAACCTGGCCCTGCTCTGGCCTGGCTCCTGCTCCTGAGCCTG
CTGGCGGATTGTCTGAAAGCTGCTCAGTCCCGAGACTTCACAGTGAAAGACATTATCTAC
CTCCATCCTTCAACCACACCATATCCTGGTGGATTTAAATGTTTCACCTGTGAAAAGGCA
GCAGACAATTATGAGTGCAACCGATGGGCTCCAGACATCTACTGCCCTCGAGAGACCAGA
TACTGCTACACTCAGCACACAATGGAAGTCACAGGAAACAGTATCTCAGTCACCAAACGC
TGTGTCCCACTGGAAGAGTGCTTATCCACTGGCTGCAGAGACTCCGAGCATGAAGGCCAC
AAGGTCTGCACTTCTTGTTGTGAAGGAAATATCTGTAACTTGCCACTGCCCCGAAATGAA
ACTGATGCCACATTTGCCACGACGTCACCTATAAATCAGACAAATGGGCACCCACGCTGT
ATGTCAGTGATAGTGTCCTGCTTGTGGTTGTGGTTAGGGCTCATGTTATAGTGGCTCAGT
GGCTCCATGTGTTAATAGCGATCCATGGGGATCTCGATGGTCCACAGACCTGCATGAGTC
ATTGGCCTGACAGTAATTACACATGTGAGACACAACACTCTTGGAGGTCATCACAGCCAA
GCATTGCCACTTACCATGAGGAATAAATGTTGCTTCATTGTAGCCATTTTGAGTCTAACC
GAGACTCATCAAAGCCTTCTGTCAGTACAGCCCAAGTTCCATACCATAAACGTTTGTTTT
CATTCCAAGAAGTAGTTCTGCATTTATCGAGATCTGGGGTTCTTAATTTGGAAGAATACA
TGCATGAGATGCAGTAGGTCCTGAGACTGTAAGATATTAGGAGTATGTTATAGGGCATG
TATAGATGTGGGCTTTTCAGGAGAAAAGTAACCATTGGTTTAAATATAATCATGAGTTCA
TTTGTAGCTTTAGAATTTTAAAACATTGACTCCAAACTGAATGGACTATTTCCTTGGAAA
TTCTGACTGAGTCCCTGGAAGAGTAGTAATTCCAACAATTCCAGCCATTTGTTCAATTAA
TTTTCCCAACATTCTTCTCCCAGTGCTGGGAATCACATTTCCTCTGTTCTGTGCAGAAGA
CAAAAAGGCAATCATAAAAGTTTGTTATATTTGTGGGGGTGCCTGGAGGAGGATTTTCCT
CAACTTAATGGAGCCACTGTCCATAAAGTGGCTGTTATCCCTTCATATAATTGGTGAGAT
CAGCCTTCTCCTTGACTTGGCACCTAATTATGCTTCATGAGATCCTAGATTCCACCTGAG
TCAATTGTGTCCAGAGCCCCAAACCAGGATGGAGTTGTTTTCCCCAGATATGGGGTTCTA
TTCAGCCATAGATAATCTAGACAGAGGATTTCAGAATGAAAGGAAAAATGTGTGGAGATT
AGTCCTAGTTCATTCTGAGGGCCGACTAAGTGGCTCAGCCAGCTTCTTACTCCATCTGCA
GTTCATACTGCCAAAGAGCTCCCACTTCCAAATCCCCAGTGACTTTATGGAGAAGATTCT
GCATTAAATTGTCTTTCGAATGATGGGAAGCAAGGCATAATATGCGATGATGAGGAGAA
AGTAGACCAGTGAGGTGATTGCAAGACTAACAAGGAGACTCAATGGGAAGTTTTCTTTC
TTTTAGATATTGCTTTTGAAGTAGATGGTAAAATTTTTGTCATCCTTCTTGTATTTTTG
TACCCCAAGTTACAATTTTTCTTCTTCCTTGTAAATAATTTAAACAGTATTTATTTTGT
AAGGCATAACTAGAAACTAAAATATATTCTAAAAAATTCATTATTCTGAACAAAGTGATC
AAATTAGAATACATATTTTTCAACAGTGGTAGAGCTTTTAATATATGTTTATTGAAAGTT
ATCTATAATACTTGCACCAGTGTTGAAAAAGTTAACATGTAGGCAAGAGCAATATGTTT
GTCTCAAGGATTTTTCCATGGTTTCCTCAGTGATGGTGTCCTGGAATTATTCAGGTGGTG
ACCATCACTGGTCTAAGTTTGTGTGCAGGGTTTTCAGACGTGTTTTTGTGAAACTTGGTA
GAACCATGGCTAATAAAGAGGACAGTGTTGTCAGGGTCCATCTGCCCTCCATAGAAAAAT
GTCTCTGGCTCATAAAATGAGACTCCCTCAGGGACTAAATGAACTGACAGCAGTAACT
CTGATACAGAATAATCTAAATTGCATCAAATGGCCTTAATTCAGAGTTTGTTAGGCTTAT
CAGTATGTTGCTTTTAATTGGGGTGGGAAAGTAGAGGGAGAGAAAGCAAGACATTTATTA
AGCACCTCGTATGTGCCAGGCACTATGCTAAGCACTTTACATAAGTTAGGATTAATCCCT
GCAAGAATCCTATAAAGAATGTTACTAGCATTTACACTTCCCAAATGAAGGTACCAAAGC
TCAAACGCAATGTTGTGAAGCTGTTTCCTTCAGATTTAGGTTATGTGGGATGATGTGGGA
TTGAAGAGGAAAGAAAGGTGGGATTATCCCCCTAGGAAGACTTTCAGGCCTGACTTCATA
GGAATTCATCCATCTTATCATGTGGAGTTTATCTCACCCTGCTGTTGCAGGATGCTATTT
GCATGTGTCCCCAGGTGATGTTTTTCTTTGGGGAGTAGGGGTTTGGCTTCCTCATTCAT
```

FIGURE 345
(continued)

```
CCCTCTTGCTAAAAGAGGAGATAGTTGATGTTGCATCTAAAGATGCTATAAGACAATGAAAGTTTGATGTTGTAC
ATACCTACAAGTACCATTTTTGTGCATGATTACACTCCACTGACATCTTCCAAGTACTAC
ATGTGATTGAATAAGAAACAAGAAAGTGACCACACCAAAGCCTCCCTGGCTGGTGTACAG
GGATCAGGTCCACAGTGGTGCAGATTCAACCACCACCCAGGGAGTGCTTGCAGACTCTGC
ATAGATGTTGCTGCATGCGTCCCATGTGCCTGTCAGAATGGCAGTGTTTAATTCTCTTGA
AAGAAAGTTATTTGCTCACTATCCCCAGCCTCAAGGAGCCAAGGAAGAGTCATTCACATG
GAAGGTCCGGGACTGGTCAGCCACTCTGACTTTTCTACCACATTAAATTCTCCATTACAT
CTCACTATTGGTAATGGCTTAAGTGTAAAGAGCCATGATGTGTATATTAAGCTATGTGCC
ACATATTTATTTTTAGACTCTCCACAGCATTCATGTCAATATGGGATTAATGCCTAAACT
TTGTAAATATTGTACAGTTTGTAAATCAATGAATAAAGGTTTTGAGTGTAAAAAAAAAAA
AAAAAA
```

FIGURE 346

MEPGPALAWLLLLSLLADCLKAAQSRDFTVKDIIYLHPSTTPYPGGFKCFTCEKAADNYE
CNRWAPDIYCPRETRYCYTQHTMEVTGNSISVTKRCVPLEECLSTGCRDSEHEGHKVCTS
CCEGNICNLPLPRNETDATFATTSPINQTNGHPRCMSVIVSCLWLWLGLML

Important features of the protein:

Signal peptide:
1-22

Transmembrane domain:
None

N-glycosylation site:
134-138, 147-151

N-myristoylation site:
45-51, 87-93, 106-112, 124-130

Ly-6 / u-PAR domain protein:
115-128

FIGURE 347

```
GATCAAGCGCCTTCCTTTCCCTTCCTCTCCCTACTTGGCCTTTGCCCTAAGCCAAGACCT
GGCCATCAGCCTGGCTGCAGGGGCCTGCAGAGCCAGCTGCACTTTTTCAGGTATGGGGGA
GGGCCAGGCACCATGAAGCCAGTGTGGGTCGCCACCCTTCTGTGGATGCTACTGCTGGTG
CCCAGGCTGGGGCCGCCCGGAAGGGGTCCCCAGAAGAGGCCTCCTTCTACTATGGAACC
TTCCCTCTTGGCTTCTCCTGGGGCGTGGGCAGTTCTGCCTACCAGACGGAGGGCGCCTGG
GACCAGGACGGGAAAGGGCCTAGCATCTGGGACGTCTTCACACACAGTGGGAAGGGGAAA
GTGCTTGGGAATGAGACGGCAGATGTAGCCTGTGACGGCTACTACAAGGTCCAGGAGGAC
ATCATTCTGCTGAGGGAACTGCACGTCAACCACTACCGATTCTCCCTGTCTTGGCCCCGG
CTCCTGCCCACAGGCATCCGAGCCGAGCAGGTGAACAAGAAGGGAATCGAATTCTACAGT
GATCTTATCGATGCCCTTCTGAGCAGCAACATCACTCCCATCGTGACCTTGCACCACTGG
GATCTGCCACAGCTGCTCCAGGTCAAATACGGTGGGTGGCAGAATGTGAGCATGGCCAAC
TACTTCAGAGACTACGCCAACCTGTGCTTTGAGGCCTTTGGGGACCGTGTGAAGCACTGG
ATCACGTTCAGTGATCCTCGGGCAATGGCAGAAAAAGGCTATGAGACGGGCCACCATGCG
CCGGGCCTGAAGCTCCGCGGCACCGGCCTGTACAAGGCAGCACACCACATCATTAAGGCC
CACGCCAAAACCTGGCATTCTTATAACACCACGTGGCGCAGCAAGCAGCAAGGTCTGGTG
GGAATTTCACTGAACTGTGACTGGGGGGAACCTGTGGACATTAGTAACCCCAAGGACCTA
GAGGCTGCCGAGAGATACCTACAGTTCTGTCTGGGCTGGTTTGCCAACCCCATTTATGCC
GGTGACTACCCCAAGTCATGAAGGACTACATTGGAAGAAAGAGTGCAGAGCAAGGCCTG
GAGATGTCGAGGTTACCGGTGTTCTCACTCCAGGAGAAGAGCTACATTAAAGGCACATCC
GATTTCTTGGGATTAGGTCATTTTACTACTCGGTACATCACGGAAAGGAACTACCCCTCC
CGCCAGGGGCCCAGCTACCAGAACGATCGTGACTTGATAGAGCTGGTTGACCCAAACTGG
CCAGATCTGGGGTCTAAATGGCTATATTCTGTGCCATGGGGATTTAGGAGGCTCCTTAAC
TTTGCTCAGACTCAATACGGTGATCCTCCCATATATGTGATGGAAAATGGAGCATCTCAA
AAATTCCACTGTACTCAATTATGTGATGAGTGGAGAATTCAATACCTTAAAGGATACATA
AATGAAATGCTAAAAGCTATAAAGATGGTGCTAATATAAAGGGGTATACTTCCTGGTCT
CTGTTGGATAAGTTTGAATGGGAGAAAGGATACTCAGATAGATATGGATTCTACTATGTT
GAATTTAACGACAGAAATAAGCCTCGCTATCCAAAGGCTTCAGTTCAATATTACAAGAAG
ATTATCATTGCCAATGGGTTTCCCAATCCAAGAGAGGTGGAAAGTTGGTACCTCAAAGCT
TTGGAAACTTGCTCTATCAACAATCAGATGCTTGCTGCAGAGCCTTTGCTAAGTCACATG
CAAATGGTTACGGAGATCGTGGTACCCACTGTCTGCTCCCTCTGTGTCCTCATCACTGCT
GTTCTACTAATGCTCCTCCTGAGGAGGCAGAGCTGAGACAGGATTATCAATTTTGGAGCT
TCATAAGAGAATCTTCAGGATCTTCCTCCCTTTTCTGCTTTGAGGGTTTCCATACATTGC
TGTTTTCAGGTTCTACAATAATTACCTTTTTTCTCTTTCTCTTTTTGGCTTGTGCTGGG
ATTTAAGAATTAGAAAATAAAAATAAGCAGAAATTA
```

FIGURE 348

```
MKPVWVATLLWMLLLVPRLGAARKGSPEEASFYYGTFPLGFSWGVGSSAYQTEGAWDQDG
KGPSIWDVFTHSGKGKVLGNETADVACDGYYKVQEDIILLRELHVNHYRFSLSWPRLLPT
GIRAEQVNKKGIEFYSDLIDALLSSNITPIVTLHHWDLPQLLQVKYGGWQNVSMANYFRD
YANLCFEAFGDRVKHWITFSDPRAMAEKGYETGHHAPGLKLRGTGLYKAAHHIIKAHAKT
WHSYNTTWRSKQQGLVGISLNCDWGEPVDISNPKDLEAAERYLQFCLGWFANPIYAGDYP
QVMKDYIGRKSAEQGLEMSRLPVFSLQEKSYIKGTSDFLGLGHFTTRYITERNYPSRQGP
SYQNDRDLIELVDPNWPDLGSKWLYSVPWGFRRLLNFAQTQYGDPPIYVMENGASQKFHC
TQLCDEWRIQYLKGYINEMLKAIKDGANIKGYTSWSLLDKFEWEKGYSDRYGFYYVEFND
RNKPRYPKASVQYYKKIIANGFPNPREVESWYLKALETCSINNQMLAAEPLLSHMQMVT
EIVVPTVCSLCVLITAVLLMLLLRRQS
```

Important features:
Signal peptide:
amino acids 1-21

Transmembrane domain:
amino acids 541-558

N-glycosylation sites:
amino acids 80-84,171-175,245-249

Glycosaminoglycan attachment site:
amino acids 72-76 cAMP- and cGMP-dependent protein kinase phosphorylation sites:
amino acids 23-27,564-568

Tyrosine kinase phosphorylation sites:
amino acids 203-211,347-355,460-468,507-514

N-myristoylation sites:
amino acids 44-50,79-85,167-173,225-231,257-263,315-321

Amidation site:
amino acids 307-311

Glycosyl hydrolases family 1 active site:
amino acids 407-416

Glycosyl hydrolases family 1 N-terminal signature:
amino acids 41-56

Motif name Glycosyl hydrolases family:
amino acids 37- 67

FIGURE 349

```
CGCAAAGCCGCCCTCGGGGCGCTCATGGCGGGACGCCTCCTGGGAAAGGCTTTAGCCGCG
GTGTCTCTCTCTCTGGCCTTGGCCTCTGTGACTATCAGGTCCTCGCGCTGCCGCGGCATC
CAGGCGTTCAGAAACTCGTTTTCATCTTCTTGGTTTCATCTTAATACCAACGTCATGTCT
GGTTCTAATGGTTCCAAAGAAAATTCTCACAATAAGGCTCGGACGTCTCCTTACCCAGGT
TCAAAAGTTGAACGAAGCCAGGTTCCTAATGAGAAAGTGGGCTGGCTTGTTGAGTGGCAA
GACTATAAGCCTGTGGAATACACTGCAGTCTCTGTCTTGGCTGGACCCAGGTGGGCAGAT
CCTCAGATCAGTGAAAGTAATTTTTCTCCCAAGTTTAACGAAAAGGATGGGCATGTTGAG
AGAAAGAGCAAGAATGGCCTGTATGAGATTGAAAATGGAAGACCGAGAAATCCTGCAGGA
CGGACTGGACTGGTGGGCCGGGGCTTTTGGGGCGATGGGGCCCAAATCACGCTGCAGAT
CCCATTATAACCAGATGGAAAAGGGATAGCAGTGGAAATAAAATCATGCATCCTGTTTCT
GGGAAGCATATCTTACAATTTGTTGCAATAAAAAGGAAAGACTGTGGAGAATGGGCAATC
CCAGGGGGGATGGTGGATCCAGGAGAGAAGATTAGTGCCACACTGAAAAGAGAATTTGGT
GAGGAAGCTCTCAACTCCTTACAGAAAACCAGTGCTGAGAAGAGAGAAATAGAGGAAAAG
TTGCACAAACTCTTCAGCCAAGACCACCTAGTGATATATAAGGGATATGTTGATGATCCT
CGAAACACTGATAATGCATGGATGGAGACAGAAGCTGTGAACTACCATGACGAAACAGGT
GAGATAATGGATAATCTTATGCTAGAAGCTGGAGATGATGCTGGAAAAGTGAAATGGGTG
GACATCAATGATAAACTGAAGCTTTATGCCAGTCACTCTCAATTCATCAAACTTGTGGCT
GAGAAACGAGATGCACACTGGAGCGAGGACTCTGAAGCTGACTGCCATGCGTTGTAGCTG
ATGGTCTCCGTGTAAGCCAAAGGCCCACAGAGGAGCATATACTGAAAAGAAGGCAGTATC
ACAGAATTTATACTATAAAAGGGCAGGGTAGGCCACTTGGCCTATTTACTTTCAAAACA
ATTTGCATTTAGAGTGTTTCGCATCAGAATAACATGAGTAAGATGAACTGGAACACAAAA
TTTTCAGCTCTTTGGTCAAAAGGAATATAAGTAATCATATTTTGTATGTATTCGATTTAA
GCATGGCTTAAATTAAATTTAAACAACTAATGCTCTTTGAAGAATCATAATCAGAATAAA
GATAAATTCTTGATCAGCTATA
```

FIGURE 350

```
MAGRLLGKALAAVSLSLALASVTIRSSRCRGIQAFRNSFSSSWFHLNTNVMSGSNGSKEN
SHNKARTSPYPGSKVERSQVPNEKVGWLVEWQDYKPVEYTAVSVLAGPRWADPQISESNF
SPKFNEKDGHVERKSKNGLYEIENGRPRNPAGRTGLVGRGLLGRWGPNHAADPIITRWKR
DSSGNKIMHPVSGKHILQFVAIKRKDCGEWAIPGGMVDPGEKISATLKREFGEEALNSLQ
KTSAEKREIEEKLHKLFSQDHLVIYKGYVDDPRNTDNAWMETEAVNYHDETGEIMDNLML
EAGDDAGKVKWVDINDKLKLYASHSQFIKLVAEKRDAHWSEDSEADCHAL
```

Important features of the protein:

Signal peptide:
1-20

Transmembrane domain:
None

N-glycosylation site:
55-59 cAMP- and cGMP-dependent protein kinase phosphorylation site:
179-183

N-myristoylation site:
53-59, 56-62 mutT domain signature:
215-235

FIGURE 351

```
CCTCTGTCTGTGCTCCCATCCCAGGGAGTATAGGTGGAGCCTCCAGAGCCCATGGACAGG
GCATGCTGGGGCTGGGCCAGCCCCAGCGGTGTCTCTAAGGCACCCCTGGGATCCCCACTG
AGCTGGCCTACTTCAGACAGCCAGGGCCCACCCCTCTGGCCCCCTTAGTGTCCAGCTCGT
GGCCCCTTGGCATTTCCACAAGACGCCAAGATGGAGATTCCCATGGGGACCCAGGGCTGC
TTCTCAAAGAGCCTCCTGCTCTCAGCCTCAATCCTGGTCCTCTGGATGCTCCAAGGCTCC
CAGGCAGCTCTCTACATCCAGAAGATTCCAGAGCAGCCTCAAAAGAACCAGGACCTTCTC
CTGTCAGTCCAGGGTGTCCCAGACACCTTCCAGGACTTCAACTGGTACCTGGGGGAGGAG
ACGTACGGAGGCACGAGGCTATTTACCTACATCCCTGGGATACAACGGCCTCAGAGGGAT
GGCAGTGCCATGGGACAGCGAGACATCGTGGGCTTCCCCAATGGTTCCATGCTGCTGCGC
CGCGCCCAGCCTACAGACAGTGGCACCTACCAAGTAGCCATTACCATCAACTCTGAATGG
ACTATGAAGGCCAAGACTGAGGTCCAGGTAGCTGAAAAGAATAAGGAGCTGCCCAGTACA
CACCTGCCCACCAACGCTGGGATCCTGGCGGCCACCATCATTGGATCTCTTGCTGCCGGG
GCCCTTCTCATCAGCTGCATTGCCTATCTCCTGGTGACAAGGAACTGGAGGGGCCAGAGC
CACAGACTGCCTGCTCCGAGGGGCCAGGGATCTCTGTCCATCTTGTGCTCGGCTGTATCC
CCAGTGCCTTCAGTGACGCCCAGCACATGGATGGCGACCACAGAGAAGCCAGAATTGGGC
CCTGCTCATGATGCTGGTGACAACAACATCTATGAAGTGATGCCCTCTCCAGTCCTCCTG
GTGTCCCCCATCAGTGACACAAGGTCCATAAACCCAGCCCGGCCCCTGCCCACACCCCCA
CACCTGCAGGCGGAGCCAGAGAACCACCAGTACCAGCAGGACCTGCTAAACCCCGACCCT
GCCCCCTACTGCCAGCTGGTGCCAACTTCCTGATGGGTCCTGGGCCAGGCCAGCCAGGGA
GAAGACAAGGCCCCAGCCCTCCTCTGGGAGCCTCACACCTGAGACCAGCAGGACAAGGCC
ATTGGGGGCTGTGGGGCCGATGAGGTGGACTCAGCCAAAGACTCAGCAGCACATGGGGCA
GGTGTCCTGGCAGGGGACAGGAGACTGTAACAGGCCCAGGTCCTTGTGCAGCCCCTGAA
TGCACGCCCGCCTTCGGTCTGTTCCTTCAAGCAAGCTGGCCTGGCCATGTGCCTGTGAA
AGGCAGGCTCTGGCCCCTTTCCATGCCAAAGTCCCCCAAGATCTGGATATCTGGGGACAA
GATGGTGGCCTCAGGCCTGCCTCCCAGGCAGTTGGCTGGGCTCCCAACTGTCTGTCCTCA
ATGCCCTACCCCAACTCCACTAGTGACCCTCAGAGTCTTCTCCCCTTAGGACAAGGCAGA
CACCCCACCATGCGGGCCTCAGGTGGCAGAGAGGCCCAGCCTCACAGGCCTGTGGCCCCA
CACACCAGTCCCAGCAAGGTGACCACGGCTGCTGGACCCCTTCCCTGTTCAGGCAGGCCC
AGCCCCTCTCAGAACCTGCTGCCAGCTGCTGGTCTTGGCCCCCACCCTGAATCTTACTGA
GTCCCTCTGGGCAGCAGCTCCCTTCTCCACCCCACCCCAGCACCCGTCCCAAATGTGGCC
TCAGCTTGTCCTCCCCTTCCCCAAACTATGCATTCATTCAGCAATAAATGAGCCTTTGCT
GCA
```

FIGURE 352

MEIPMGTQGCFSKSLLLSASILVLWMLQGSQAALYIQKIPEQPQKNQDLLLSVQGVPDTF
QDFNWYLGEETYGGTRLFTYIPGIQRPQRDGSAMGQRDIVGFPNGSMLLRRAQPTDSGTY
QVAITINSEWTMKAKTEVQVAEKNKELPSTHLPTNAGILAATIIGSLAAGALLISCIAYL
LVTRNWRGQSHRLPAPRGQGSLSILCSAVSPVPSVTPSTWMATTEKPELGPAHDAGDNNI
YEVMPSPVLLVSPISDTRSINPARPLPTPPHLQAEPENHQYQQDLLNPDPAPYCQLVPTS

Important features of the protein:
Signal peptide:
Amino acids 1-32

Transmembrane domain:
Amino acids 159-178

N-glycosylation site:
Amino acids 104-108

N-myristoylation sites:
Amino acids 6-12;29-35;55-61;91-97;157-163;165-171

FIGURE 353

CTTCAGAACAGGTTCTCCTTCCCCAGTCACCAGTTGCTCGAGTTAGAATTGTCTGCAATG
GCCGCCCTGCAGAAATCTGTGAGCTCTTTCCTTATGGGGACCCTGGCCACCAGCTGCCTC
CTTCTCTTGGCCCTCTTGGTACAGGGAGGAGCAGCTGCGCCCATCAGCTCCCACTGCAGG
CTTGACAAGTCCAACTTCCAGCAGCCCTATATCACCAACCGCACCTTCATGCTGGCTAAG
GAGGCTAGCTTGGCTGATAACAACACAGACGTTCGTCTCATTGGGGAGAAACTGTTCCAC
GGAGTCAGTATGAGTGAGCGCTGCTATCTGATGAAGCAGGTGCTGAACTTCACCCTTGAA
GAAGTGCTGTTCCCTCAATCTGATAGGTTCCAGCCTTATATGCAGGAGGTGGTGCCCTTC
CTGGCCAGGCTCAGCAACAGGCTAAGCACATGTCATATTGAAGGTGATGACCTGCATATC
CAGAGGAATGTGCAAAAGCTGAAGGACACAGTGAAAAAGCTTGGAGAGAGTGGAGAGATC
AAAGCAATTGGAGAACTGGATTTGCTGTTTATGTCTCTGAGAAATGCCTGCATTTGACCA
GAGCAAAGCTGAAAAATGAATAACTAACCCCCTTTCCCTGCTAGAAATAACAATTAGATG
CCCCAAAGCGATTTTTTTTAACCAAAAGGAAGATGGGAAGCCAAACTCCATCATGATGGG
TGGATTCCAAATGAACCCCTGCGTTAGTTACAAAGGAAACCAATGCCACTTTTGTTTATA
AGACCAGAAGGTAGACTTTCTAAGCATAGATATTTATTGATAACATTTCATTGTAACTGG
TGTTCTATACACAGAAAACAATTTATTTTTTAAATAATTGTCTTTTTCCATAAAAAAGAT
TACTTTCCATTCCTTTAGGGGAAAAAACCCCTAAATAGCTTCATGTTTCCATAATCAGTA
CTTTATATTTATAAATGTATTTATTATTATTATAAGACTGCATTTTATTTATATCATTTT
ATTAATATGGATTTATTTATAGAAACATCATTCGATATTGCTACTTGAGTGTAAGGCTAA
TATTGATATTTATGACAATAATTATAGAGCTATAACATGTTTATTTGACCTCAATAAACA
CTTGGATATCCC

FIGURE 354

MAALQKSVSSFLMGTLATSCLLLLALLVQGGAAAPISSHCRLDKSNFQQPYITNRTFMLA
KEASLADNNTDVRLIGEKLFHGVSMSERCYLMKQVLNFTLEEVLFPQSDRFQPYMQEVVP
FLARLSNRLSTCHIEGDDLHIQRNVQKLKDTVKKLGESGEIKAIGELDLLFMSLRNACI

Important features of the protein:
Signal peptide:
amino acids 1-33

N-glycosylation sites:
amino acids 54-58, 68-72, 97-101

N-myristoylation sites:
amino acids 14-20, 82-88

Prokaryotic membrane lipoprotein lipid attachment site:
amino acids 10-21

FIGURE 355

```
TGGCCTACTGGAAAAAAAAAAAAAAAAAAAAAAAGTCACCCGGGCCCGCGGTGGCCACAA
CATGGCTGCGGCGCCGGGGCTGCTCTTCTGGCTGTTCGTGCTGGGGGCGCTCTGGTGGGT
CCCGGGCCAGTCGGATCTCAGCCACGGACGGCGTTTCTCGGACCTCAAAGTGTGCGGGGA
CGAAGAGTGCAGCATGTTAATGTACCGTGGGAAAGCTCTTGAAGACTTCACGGGCCCTGA
TTGTCGTTTTGTGAATTTTAAAAAAGGTGACGATGTATATGTCTACTACAAACTGGCAGG
GGGATCCCTTGAACTTTGGGCTGGAAGTGTTGAACACAGTTTTGGATATTTTCCAAAAGA
TTTGATCAAGGTACTTCATAAATACACGGAAGAAGAGCTACATATTCCAGCAGATGAGAC
AGACTTTGTCTGCTTTGAAGGAGGAAGAGATGATTTTAATAGTTATAATGTAGAAGAGCT
TTTAGGATCTTTGGAACTGGAGGACTCTGTACCTGAAGAGTCGAAGAAAGCTGAAGAAGT
TTCTCAGCACAGAGAGAAATCTCCTGAGGAGTCTCGGGGGCGTGAACTTGACCCTGTGCC
TGAGCCCGAGGCATTCAGAGCTGATTCAGAGGATGGAGAAGGTGCTTTCTCAGAGAGCAC
CGAGGGGCTGCAGGGACAGCCCTCAGCTCAGGAGAGCCACCCTCACACCAGCGGTCCTGC
GGCTAACGCTCAGGGAGTGCAGTCTTCGTTGGACACTTTTGAAGAAATTCTGCACGATAA
ATTGAAAGTGCCGGGAAGCGAAAGCAGAACTGGCAATAGTTCTCCTGCCTCGGTGGAGCG
GGAGAAGACAGATGCTTACAAAGTCCTGAAAACAGAAATGAGTCAGAGAGGAAGTGGACA
GTGCGTTATTCATTACAGCAAAGGATTTCGTTGGCATCAAAATCTAAGTTTGTTTTACAA
AGATTGTTTTTAGTACTAAGCTGCCTTGGCAGTTTGCATTTTTGAGCCAAACAAAATAT
ATTATTTTCCCTTCTAAGTAAAAAAAAAAAAAAAAAAAA
```

FIGURE 356

MAAAPGLLFWLFVLGALWWVPGQSDLSHGRRFSDLKVCGDEECSMLMYRGKALEDFTGPD
CRFVNFKKGDDVYVYYKLAGGSLELWAGSVEHSFGYFPKDLIKVLHKYTEEELHIPADET
DFVCFEGGRDDFNSYNVEELLGSLELEDSVPEESKKAEEVSQHREKSPEESRGRELDPVP
EPEAFRADSEDGEGAFSESTEGLQGQPSAQESHPHTSGPAANAQGVQSSLDTFEEILHDK
LKVPGSESRTGNSSPASVEREKTDAYKVLKTEMSQRGSGQCVIHYSKGFRWHQNLSLFYK
DCF

Important features of the protein:
Signal peptide:
amino acids 1-22

N-glycosylation site:
amino acids 294-298 cAMP- and cGMP-dependent protein kinase phosphorylation site:
amino acids 30-34

Tyrosine kinase phosphorylation site:
amino acids 67-76

N-myristoylation sites:
amino acids 205-211, 225-231, 277-283

Amidation site:
amino acids 28-32

FIGURE 357

ACGCGCCCGGCAGCTGTCCACCGATCCCGGCCACCGCCCCCGGCCACCCCCACCCCGCGA
GCCCATGGAGGCTCCGGGACCCCGCGCCTTGCGGACTGCGCTCTGTGGCGGCTGTTGCTG
CCTCCTCCTATGTGCCCAGCTGGCTGTGGCTGGTAAAGGAGCTCGAGGCTTTGGGAGGGG
AGCCCTGATCCGCCTGAATATCTGGCCGGCGGTCCAAGGGGCCTGCAAACAGCTGGAGGT
CTGTGAGCACTGCGTGGAGGGAGACAGAGCGCGCAATCTCTCCAGCTGCATGTGGGAGCA
GTGCCGGCCAGAGGAGCCAGGACACTGTGTGGCCCAATCTGAGGTGGTCAAGGAAGGTTG
CTCCATCTACAACCGCTCAGAGGCATGTCCAGCTGCTCACCACCACCCCACCTATGAACC
GAAGACAGTCACAACAGGGAGCCCCCAGTCCCTGAGGCCCACAGCCCTGGATTTGACGG
GGCCAGCTTTATCGGAGGTGTCGTGCTGGTGTTGAGCCTACAGGCGGTGGCTTTCTTTGT
GCTGCACTTCCTCAAGGCCAAGGACAGCACCTACCAGACGCTGTGAGTACCTGGCCAGCA
GCAAGTACCTGAGTCCCAGCTCACCTCCTGGTTCCTGCCCCACCGTTCCCCTTCAGTACC
CAGGGTGCTGTCTTCTCCATGGGCAAGCCCTCAGGACGGTGACAGCGTGCTCCATGTGAG
CCACACCCCTTTTGTCTCCTCCAGTTGGGGTGTTTCCTTTGTCAGATGTTGGCTGGGACC
AGGACTCAGCCTGGGCCAGTCTAGGAGCCCAGCTGAGCCCTCCTGTGTCTTTTCCCTTCA
TGCTGCCAGCAGGGAAGAGAACCAGTAGGTGCCAGCCCAGGCAAGCCTGTGGCCCGCGTT
TCTGTGGCTGTGGGCAGGAGCTGGGCCTTGTGTCTAGTTGGGTTTTGCTCTGAGAAGGGG
AGCTGTGCCTGAGGCCCTCTGTGTGCCGTGTGTGCTGTGGGGCGGGTCGCCACAGCCTGT
GTTAAAGTGTTTGCTCTTCCTCTGCTGCCTCCTCGAGGCAGGGGGTCCTTGGCTGGCT
GAGGCAGTGTCACCTTCCTGAGTGTCCTCTTTGGCCTCTGCAGAATCTGACCCCTTTGGG
CCTGGACTCCATCCTGAGGGGAAAGGAGGATGCAGAGGGTGGCCTCTGGGCACCCTTGTG
GGTAAGCGGGGGGCGGGGCGGGAAAAACTCTGGCCGCCAGTTTTTGGCTCCTGCGGGCA
CCAAGCAGGCTCAGTGTCTGATGCCTGACATCTCCTCCTGTCCTGGGCCTGGAACCTGCA
GCTGAGAAAATCCCTCAACCACCTCGTCTCCTCCATCGCCCTGCTGGGCCCCCAGCCT
GACAGTGGGTTGTATGCCTGCCTCTTTCCACCAACTGGCCTGGGCACTGCCCCCAAATAA
AGGAACTCTGCACTGCAAAAAAAAAAAAAAAAAAAAAAAAAAAAAAAAAAAAAAAAAAAA
AAAAAAAAAAAAACCA

FIGURE 358

MEAPGPRALRTALCGGCCCLLLCAQLAVAGKGARGFGRGALIRLNIWPAVQGACKQLEVC
EHCVEGDRARNLSSCMWEQCRPEEPGHCVAQSEVVKEGCSIYNRSEACPAAHHHPTYEPK
TVTTGSPPVPEAHSPGFDGASFIGGVVLVLSLQAVAFFVLHFLKAKDSTYQTL

Important features of the protein:

Signal peptide:
1-29

Transmembrane domain:
141-160

N-glycosylation site:
71-75, 103-107

Tyrosine kinase phosphorylation site:
164-171

N-myristoylation site:
15-21

FIGURE 359

TTCCAGTCAGAGTTAAGTTAAAACAGAAAAAAGGAAG<u>ATG</u>GCAAGAATATTGTTACTTTT
CCTCCCGGGTCTTGTGGCTGTATGTGCTGTGCATGGAATATTTATGGACCGTCTAGCTTC
CAAGAAGCTCTGTGCAGATGATGAGTGTGTCTATACTATTTCTCTGGCTAGTGCTCAAGA
AGATTATAATGCCCCGGACTGTAGATTCATTAACGTTAAAAAAGGGCAGCAGATCTATGT
GTACTCAAAGCTGGTAAAAGAAAATGGAGCTGGAGAATTTTGGGCTGGCAGTGTTTATGG
TGATGGCCAGGACGAGATGGGAGTCGTGGGTTATTTCCCCAGGAACTTGGTCAAGGAACA
GCGTGTGTACCAGGAAGCTACCAAGGAAGTTCCCACCACGGATATTGACTTCTTCTGCGA
G<u>TAA</u>TAAATTAGTTAAAACTGCAAATAGAAAGAAAACACCAAAAATAAAGAAAAGAGCAA
AAGTGGCCAAAAAATGCATGTCTGTAATTTTGGACTGACGT

FIGURE 360

MARILLLFLPGLVAVCAVHGIFMDRLASKKLCADDECVYTISLASAQEDYNAPDCRFINV
KKGQQIYVYSKLVKENGAGEFWAGSVYGDGQDEMGVVGYFPRNLVKEQRVYQEATKEVPT
TDIDFFCE

Important features of the protein:

Signal peptide:
1-14

Transmembrane domain:
None

N-myristoylation site:
84-90

FIGURE 361

```
GGCACGAGCCACCACTTACAACCACACAGCCTATCCAGAAACATGAAGATAAGAAATGCT
TGTGCTGTCCTTATTGAAGTACTCCTGTTTATACTTGAAGGAGTTACAGGAGCTCGAAAA
ATTTCAACTTTCTCAGGCCCTGGCTCATGGCCGTGCAATCCCAAGTGTGATGGCAGAACT
TACAACCCCTCAGAGGAGTGTTGTGTTCATGACACCATCCTGCCCTTTAAGCGGATTAAC
CTCTGTGGCCCTAGCTGCACCTACAGGCCCTGCTTTGAGCTCTGCTGTCCTGAGTCCTAT
AGCCCCAAGAAGAAATTTATTGTCAAGCTTAAAGTTCATGGAGAGAGATCCCATTGCAGT
TCATCCCCTATCTCCAGGAACTGTAAAAGCAACAAGATTTTTCATGGAGAAGATATTGAA
GACAACCAACTTTCTCTTAGGAAAAAAAGTGGTGACCAGCCTTGAGAGTCTGCTTTCTTC
CTGCAAGCACCAGTTCCTGAATGTTCTTACTTGAAGAATGGATACCTGAAGCATTGGGGT
GCAGTGATATATGTGTCTCATTACAATGCTCCTTTGGATATTGTTTTCCTAAGCATGTGT
TGGAATGTTCCCCCATAACTTTCTAAAATTATCCTATTTCAATGCAACTAAAGATAAATG
TATTCCAGCCAGAGTCCACAGAGAAGGCAAGTTATGCAAGGCAGGCATGGGGCCCTCACA
AAATTTCAAGCTGTGCGACTTATGTAGTAATTTTCTACAAACAATCCCTCCTGGATATCC
AGGAGGCTCCAGACCTGAATAAAAACCACATGTCTGTCTAGAAAAGGGAATGAATCAAG
ATCCACAGGACCTTTTCAAGATTTTAGAAGCAGCAAACTATGGCTGAGAGAAAAGACTCT
CTGACCAGGCAAATTGTTCTGCAGTATTCTCCGGGCGTGTAGCTCCCCTGAGTAGTCGCC
AGGCTGGTCTTGGCTTTGTAATAATACAGCTGCCTTTGAGTCCTCCCTACCCTGTTAGTA
ACCCCTTGCCTGCACTGTTGTCCTTACAACCGAAATAAACTGATTAGTTG
```

FIGURE 362

```
MKIRNACAVLIEVLLFILEGVTGARKISTFSGPGSWPCNPKCDGRTYNPSEECCVHDTIL
PFKRINLCGPSCTYRPCFELCCPESYSPKKKFIVKLKVHGERSHCSSSPISRNCKSNKIF
HGEDIEDNQLSLRKKSGDQP
```

Important features of the protein:

Signal peptide:
1-23

Transmembrane domain:
None

Glycosaminoglycan attachment site:
31-35

N-myristoylation site:
20-26, 34-40

FIGURE 363

```
ACACTGGCCAAACAAAAACGAAAGCACTCCGTGCTGGAAGTAGGAGGAGAGTCAGGACTC
CCAGGACAGAGAGTGCACAAACTACCCAGCACAGCCCCTCCGCCCCTCTGGAGGCTGA
AGAGGGATTCCAGCCCCTGCCACCCACAGACACGGGCTGACTGGGGTGTCTGCCCCCTT
GGGGGGGGGCAGCACAGGGCCTCAGGCCTGGGTGCCACCTGGCACCTAGAAGATGCCTGT
GCCCTGGTTCTTGCTGTCCTTGGCACTGGGCCGAAGCCCAGTGGTCCTTTCTCTGGAGAG
GCTTGTGGGCCTCAGGACGCTACCCACTGCTCTCCGGGCCTCTCCTGCCGCCTCTGGGA
CAGTGACATACTCTGCCTGCCTGGGGACATCGTGCCTGCTCCGGGCCCCGTGCTGGCGCC
TACGCACCTGCAGACAGAGCTGGTGCTGAGGTGCCAGAAGGAGACCGACTGTGACCTCTG
TCTGCGTGTGGCTGTCCACTTGGCCGTGCATGGGCACTGGGAAGAGCCTGAAGATGAGGA
AAAGTTTGGAGGAGCAGCTGACTCAGGGGTGGAGGAGCCTAGGAATGCCTCTCTCCAGGC
CCAAGTCGTGCTCTCCTTCCAGGCCTACCCTACTGCCCGCTGCGTCCTGCTGGAGGTGCA
AGTGCCTGCTGCCCTTGTGCAGTTTGGTCAGTCTGTGGGCTCTGTGGTATATGACTGCTT
CGAGGCTGCCCTAGGGAGTGAGGTACGAATCTGGTCCTATACTCAGCCCAGGTACGAGAA
GGAACTCAACCACACACAGCAGCTGCCTGCCCTGCCCTGGCTCAACGTGTCAGCAGATGG
TGACAACGTGCATCTGGTTCTGAATGTCTCTGAGGAGCAGCACTTCGGCCTCTCCCTGTA
CTGGAATCAGGTCCAGGGCCCCCCAAAACCCCGGTGGCACAAAAACCTGACTGGACCGCA
GATCATTACCTTGAACCACACAGACCTGGTTCCCTGCCTCTGTATTCAGGTGTGGCCTCT
GGAACCTGACTCCGTTAGGACGAACATCTGCCCCTTCAGGGAGGACCCCGCGCACACCA
GAACCTCTGGCAAGCCGCCCGACTGCGACTGCTGACCCTGCAGAGCTGGCTGCTGGACGC
ACCGTGCTCGCTGCCCGCAGAAGCGGCACTGTGCTGGCGGGCTCCGGGTGGGGACCCCTG
CCAGCCACTGGTCCCACCGCTTTCCTGGGAGAACGTCACTGTGGACAAGGTTCTCGAGTT
CCCATTGCTGAAAGGCCACCCTAACCTCTGTGTTCAGGTGAACAGCTCGGAGAAGCTGCA
GCTGCAGGAGTGCTTGTGGGCTGACTCCCTGGGGCCTCTCAAAGACGATGTGCTACTGTT
GGAGACACGAGGCCCCCAGGACAACAGATCCCTCTGTGCCTTGGAACCCAGTGGCTGTAC
TTCACTACCCAGCAAAGCCTCCACGAGGGCAGCTCGCCTTGGAGAGTACTTACTACAAGA
CCTGCAGTCAGGCCAGTGTCTGCAGCTATGGGACGATGACTTGGGAGCGCTATGGGCCTG
CCCCATGGACAAATACATCCACAAGCGCTGGGCCCTCGTGTGGCTGGCCTGCCTACTCTT
TGCCGCTGCGCTTTCCCTCATCCTCCTTCTCAAAAAGGATCACGCGAAAGGGTGGCTGAG
GCTCTTGAAACAGGACGTCCGCTCGGGGCGGCCGCCAGGGGCCGCGCGGCTCTGCTCCT
CTACTCAGCCGATGACTCGGGTTTCGAGCGCCTGGTGGGCGCCCTGGCGTCGGCCCTGTG
CCAGCTGCCGCTGCGCGTGGCCGTAGACCTGTGGAGCCGTCGTGAACTGAGCGCGCAGGG
GCCCGTGGCTTGGTTTCACGCGCAGCGGCGCCAGACCCTGCAGGAGGGCGGCGTGGTGGT
CTTGCTCTTCTCTCCCGGTGCGGTGGCGCTGTGCAGCGAGTGGCTACAGGATGGGGTGTC
CGGGCCCGGGGCGCACGGCCCGCACGACGCCTTCCGCGCCTCGCTCAGCTGCGTGCTGCC
CGACTTCTTGCAGGGCCGGGCGCCCGGCAGCTACGTGGGGCCTGCTTCGACAGGCTGCT
CCACCCGGACGCCGTACCCGCCCTTTTCCGCACCGTGCCCGTCTTCACACTGCCCTCCCA
ACTGCCAGACTTCCTGGGGGCCCTGCAGCAGCCTCGCGCCCCGCGTTCCGGCGGCTCCA
AGAGAGAGCGGAGCAAGTGTCCCGGGCCCTTCAGCCAGCCCTGGATAGCTACTTCCATCC
CCCGGGGACTCCCGCGCCGGGACGCGGGGTGGGACCAGGGCGGGACCTGGGGCGGGGGA
CGGGACTTAAATAAAGGCAGACGCTGTTTTTCTAAAAAAA
```

FIGURE 364

```
MPVPWFLLSLALGRSPVVLSLERLVGPQDATHCSPGLSCRLWDSDILCLPGDIVPAPGPV
LAPTHLQTELVLRCQKETDCDLCLRVAVHLAVHGHWEEPEDEEKFGGAADSGVEEPRNAS
LQAQVVLSFQAYPTARCVLLEVQVPAALVQFGQSVGSVVYDCFEAALGSEVRIWSYTQPR
YEKELNHTQQLPALPWLNVSADGDNVHLVLNVSEEQHFGLSLYWNQVQGPPKPRWHKNLT
GPQIITLNHTDLVPCLCIQVWPLEPDSVRTNICPFREDPRAHQNLWQAARLRLLTLQSWL
LDAPCSLPAEAALCWRAPGGDPCQPLVPPLSWENVTVDKVLEFPLLKGHPNLCVQVNSSE
KLQLQECLWADSLGPLKDDVLLLETRGPQDNRSLCALEPSGCTSLPSKASTRAARLGEYL
LQDLQSGQCLQLWDDDLGALWACPMDKYIHKRWALVWLACLLFAAALSLILLLKKDHAKG
WLRLLKQDVRSGAAARGRAALLLYSADDSGFERLVGALASALCQLPLRVAVDLWSRRELS
AQGPVAWFHAQRRQTLQEGGVVVLLFSPGAVALCSEWLQDGVSGPGAHGPHDAFRASLSC
VLPDFLQGRAPGSYVGACFDRLLHPDAVPALFRTVPVFTLPSQLPDFLGALQQPRAPRSG
RLQERAEQVSRALQPALDSYFHPPGTPAPGRGVGPGAGPGAGDGT
```

Signal sequence:
amino acids 1-20

Transmembrane domain:
amino acids 453-475

N-glycosylation sites:
amino acids 118-121, 186-189, 198-201, 211-214, 238-241, 248-251, 334-337, 357-360, 391-394

Glycosaminoglycan attachment site:
amino acids 583-586 cAMP- and cGMP-dependent protein kinase phosphorylation site:
amino acids 552-555

N-myristoylation sites:
amino acids 107-112, 152-157, 319-324, 438-443, 516-521, 612-617, 692-697, 696-701, 700-705

FIGURE 365

```
AATAGAAGTCCTCAGGACGGAGCAGAGGTGGCCGGCGGGCCCGGCTGACTGCGCCTCTGC
TTTCTTTCCATAACCTTTTCTTTCGGACTCGAATCACGGCTGCTGCGAAGGGTCTAGTTC
CGGACACTAGGGTGCCCGAACGCGCTGATGCCCCGAGTGCTCGCAGGGCTTCCCGCTAAC
CATGCTGCCGCCGCCGCGGCCCGCAGCTGCCTTGGCGCTGCCTGTGCTCCTGCTACTGCT
GGTGGTGCTGACGCCGCCCCCGACCGGCGCAAGGCCATCCCCAGGCCCAGATTACCTGCG
GCGCGGCTGGATGCGGCTGCTAGCGGAGGGCGAGGGCTGCGCTCCCTGCCGGCCAGAAGA
GTGCGCCGCGCCGCGGGGCTGCCTGGCGGGCAGGGTGCGCGACGCGTGCGGCTGCTGCTG
GGAATGCGCCAACCTCGAGGGCCAGCTCTGCGACCTGGACCCCAGTGCTCACTTCTACGG
GCACTGCGGCGAGCAGCTTGAGTGCCGGCTGGACACAGGCGGCGACCTGAGCCGCGGAGA
GGTGCCGGAACCTCTGTGTGCCTGTCGTTCGCAGAGTCCGCTCTGCGGGTCCGACGGTCA
CACCTACTCCCAGATCTGCCGCCTGCAGGAGGCGGCCCGCGCTCGGCCCGATGCCAACCT
CACTGTGGCACACCCGGGGCCCTGCGAATCGGGGCCCCAGATCGTGTCACATCCATATGA
CACTTGGAATGTGACAGGGCAGGATGTGATCTTTGGCTGTGAAGTGTTTGCCTACCCCAT
GGCCTCCATCGAGTGGAGGAAGGATGGCTTGGACATCCAGCTGCCAGGGGATGACCCCCA
CATCTCTGTGCAGTTTAGGGGTGGACCCCAGAGGTTTGAGGTGACTGGCTGGCTGCAGAT
CCAGGCTGTGCGTCCCAGTGATGAGGGCACTTACCGCTGCCTTGGCCGCAATGCCCTGGG
TCAAGTGGAGGCCCCTGCTAGCTTGACAGTGCTCACACCTGACCAGCTGAACTCTACAGG
CATCCCCCAGCTGCGATCACTAAACCTGGTTCCTGAGGAGGAGGCTGAGAGTGAAGAGAA
TGACGATTACTACTAGGTCCAGAGCTCTGGCCCATGGGGGTGGGTGAGCGGCTATAGTGT
TCATCCCTGCTCTTGAAAAGACCTGGAAAGGGGAGCAGGGTCCCTTCATCGACTGCTTTC
ATGCTGTCAGTAGGGATGATCATGGAGGCCTATTTGACTCCAAGGTAGCAGTGTGGTAG
GATAGAGACAAAAGCTGGAGGAGGGTAGGGAGAGAAGCTGAGACCAGGACCGGTGGGGTA
CAAAGGGGCCCATGCAGGAGATGCCCTGGCCAGTAGGACCTCCAACAGGTTGTTTCCCAG
GCTGGGGTGGGGGCCTGAGCAGACACAGAGGTGCAGGCACCAGGATTCTCCACTTCTTCC
AGCCCTGCTGGGCCACAGTTCTAACTGCCCTTCCTCCCAGGCCCTGGTTCTTGCTATTTC
CTGGTCCCCAACGTTTATCTAGCTTGTTTGCCCTTTCCCCAAACTCATCTTCCAGAACTT
TTCCCTCTCTCCTAAGCCCCAGTTGCACCTACTAACTGCAGTCCCTTTTGCTGTCTGCCG
TCTTTTGTACAAGAGAGAACAGCGGAGCATGACTTAGTTCAGTGCAGAGAGATTT
```

FIGURE 366

```
MLPPPRPAAALALPVLLLLLVVLTPPPTGARPSPGPDYLRRGWMRLLAEGEGCAPCRPEE
CAAPRGCLAGRVRDACGCCWECANLEGQLCDLDPSAHFYGHCGEQLECRLDTGGDLSRGE
VPEPLCACRSQSPLCGSDGHTYSQICRLQEAARARPDANLTVAHPGPCESGPQIVSHPYD
TWNVTGQDVIFGCEVFAYPMASIEWRKDGLDIQLPGDDPHISVQFRGGPQRFEVTGWLQI
QAVRPSDEGTYRCLGRNALGQVEAPASLTVLTPDQLNSTGIPQLRSLNLVPEEEAESEEN
DDYY
```

Important features of the protein:

Signal peptide:
1-30

Transmembrane domain:
None

N-glycosylation site:
159-163, 183-187, 277-281

Tyrosine kinase phosphorylation site:
244-252

N-myristoylation site:
52-58, 66-72, 113-119, 249-255

Kazal-type serine protease inhibitor domain:
121-168

Immunoglobulin domain:
186-255

Insulin-like growth factor binding proteins:
53-90

FIGURE 367

AGACGCTACAGGATGGAGCGGGGCGCAGGAGCCAAGCTGCTGCCGCTGCTGCTGCTTCTG
CGGGCGACTGGTTTCACATGTGCACAGACAGATGGCCGGAACGGCTACACGGCGGTCATC
GAAGTGACCAGCGGGGGTCCCTGGGGCGACTGGGCCTGGCCTGAGATGTGTCCCGATGGA
TTCTTCGCCAGCGGGTTCTCGCTCAAGGTGGAGCCTCCCCAAGGCATTCCTGGCGACGAC
ACTGCACTGAATGGGATCAGGCTGCACTGCGCGCGCGGGAACGTCCTAGGCAATACGCAC
GTGGTAGAGTCCCAGTCTGGAAGCTGGGGCGAATGGAGTGAGCCGCTGTGGTGTCGCGGC
GGCGCCTACCTAGTGGCTTTCTCGCTTCGCGTGGAGGCACCCACGACCCTCGGTGACAAC
ACAGCAGCGAACAACGTGCGCTTCCGCTGTTCAGACGGCGAGGAACTGCAGGGGCCTGGG
CTGAGCTGGGGAGACTTTGGAGACTGGAGTGACCATTGCCCCAAGGGCGCGTGCGGCCTG
CAGACCAAGATCCAGGGACCTAGAGGCCTCGGCGATGACACTGCGCTGAACGACGCGCGC
TTATTCTGCTGCCGCAGTTGAACGGCGCCGCCGCCGCCGCTCTCTCCCGGGCCAGGAGGC
TAGTCCCACCTCTTGCTATTAAAGCTTCTCTGAGTTG

FIGURE 368

```
MERGAGAKLLPLLLLLRATGFTCAQTDGRNGYTAVIEVTSGGPWGDWAWPEMCPDGFFAS
GFSLKVEPPQGIPGDDTALNGIRLHCARGNVLGNTHVVESQSGSWGEWSEPLWCRGGAYL
VAFSLRVEAPTTLGDNTAANNVRFRCSDGEELQGPGLSWGDFGDWSDHCPKGACGLQTKI
QGPRGLGDDTALNDARLFCCRS
```

Important features of the protein:

Signal peptide:
1-24

Transmembrane domain:
None

N-myristoylation site:
41-47
89-95
156-162

Growth factor and cytokines receptors family signature 2:
103-110

FIGURE 369

GCCAACACTGGCCAAACCTCGGAGACCGTCCTGCGCTCTCTGGAGACGCGCTGTCCGCGC
CCAGGGTGGTGCCATGTGGGGCGCTCGCCGCTCGTCCGTCTCCTCATCCTGGAACGCCGC
TTCGCTCCTGCAGCTGCTGCTGGCTGCGCTGCTGGCGGCGGGGGCGAGGGCCAGCGGCGA
GTACTGCCACGGCTGGCTGGACGCGCAGGGCGTCTGGCGCATCGGCTTCCAGTGTCCCGA
GCGCTTCGACGGCGGCGACGCCACCATCTGCTGCGGCAGCTGCGCGTTGCGCTACTGCTG
CTCCAGCGCCGAGGCGCGCCTGGACCAGGGCGGCTGCGACAATGACCGCCAGCAGGGCGC
TGGCGAGCCTGGCCGGGCGGACAAAGACGGCCCCGACGGCTCGGCAGTGCCCATCTACGT
GCCGTTCCTCATTGTTGGCTCCGTGTTTGTCGCCTTTATCATCTTGGGGTCCCTGGTGGC
AGCCTGTTGCTGCAGATGTCTCCGGCCTAAGCAGGATCCCCAGCAGAGCCGAGCCCCAGG
GGGTAACCGCTTGATGGAGACCATCCCCATGATCCCCAGTGCCAGCACCTCCCGGGGGTC
GTCCTCACGCCAGTCCAGCACAGCTGCCAGTTCCAGCTCCAGCGCCAACTCAGGGGCCCG
GGCGCCCCCAACAAGGTCACAGACCAACTGTTGCTTGCCGGAAGGGACCATGAACAACGT
GTATGTCAACATGCCCACGAATTTCTCTGTGCTGAACTGTCAGCAGGCCACCCAGATTGT
GCCACATCAAGGGCAGTATCTGCATCCCCCATACGTGGGGTACACGGTGCAGCACGACTC
TGTGCCCATGACAGCTGTGCCACCTTTCATGGACGGCCTGCAGCCTGGCTACAGGCAGAT
TCAGTCCCCCTTCCCTCACACCAACAGTGAACAGAAGATGTACCCAGCGGTGACTGTATA
ACCGAGAGTCACTGGTGGGTTCCTTTACTGAAGGGAGACGAAGGCAGGGGTGGATTTTCG
AGGTGGAAGT

FIGURE 370

```
MWGARRSSVSSSWNAASLLQLLLAALLAAGARASGEYCHGWLDAQGVWRIGFQCPERFDG
GDATICCGSCALRYCCSSAEARLDQGGCDNDRQQGAGEPGRADKDGPDGSAVPIYVPFLI
VGSVFVAFIILGSLVAACCCRCLRPKQDPQQSRAPGGNRLMETIPMIPSASTSRGSSSRQ
SSTAASSSSSANSGARAPPTRSQTNCCLPEGTMNNVYVNMPTNFSVLNCQQATQIVPHQG
QYLHPPYVGYTVQHDSVPMTAVPPFMDGLQPGYRQIQSPFPHTNSEQKMYPAVTV
```

Important features of the protein:

Signal peptide:
1-33

Transmembrane domain:
54-78

N-glycosylation site:
223-226 cAMP- and cGMP-dependent protein kinase phosphorylation site:
5-8

N-myristoylation site:
3-8, 30-35, 60-65, 86-91, 132-137, 211-216, 268-273

Prokaryotic membrane lipoprotein lipid attachment site:
128-138

FIGURE 371

```
CACCAGACAGCACTCCAGCACTCTGTTTGGGGGGCATTCGAAACAGCAAAATCACTCATA
AAAGGCAAAAATTGCAAAAAAAATAGTAATAACCAGCATGGCACTAAATAGACCATGA
AAAGACATGTGTGTGCAGTATGAAAATTGAGACAGGAAGGCAGAGTGTCAGCTTGTTCCA
CCTCAGCTGGGAATGTGCATCAGGCAACTCAAGTTTTTCACCACGGCATGTGTCTGTGAA
TGTCCGCAAAACATTCTCTCTCCCAGCCTTCATGTGTTAACCTGGGGATGATGTGGACC
TGGGCACTGTGGATGCTCCCTTCACTCTGCAAATTCAGCCTGGCAGCTCTGCCAGCTAAG
CCTGAGAACATTTCCTGTGTCTACTACTATAGGAAAAATTTAACCTGCACTTGGAGTCCA
GGAAAGGAAACCAGTTATACCCAGTACACAGTTAAGAGAACTTACGCTTTTGGAGAAAAA
CATGATAATTGTACAACCAATAGTTCTACAAGTGAAAATCGTGCTTCGTGCTCTTTTTTC
CTTCCAAGAATAACGATCCCAGATAATTATACCATTGAGGTGGAAGCTGAAATGGAGAT
GGTGTAATTAAATCTCATATGACATACTGGAGATTAGAGAACATAGCGAAAACTGAACCA
CCTAAGATTTTCCGTGTGAAACCAGTTTTGGGCATCAAACGAATGATTCAAATTGAATGG
ATAAAGCCTGAGTTGGCGCCTGTTTCATCTGATTTAAAATACACACTTCGATTCAGGACA
GTCAACAGTACCAGCTGGATGGAAGTCAACTTCGCTAAGAACCGTAAGGATAAAAACCAA
ACGTACAACCTCACGGGGCTGCAGCCTTTTACAGAATATGTCATAGCTCTGCGATGTGCG
GTCAAGGAGTCAAAGTTCTGGAGTGACTGGAGCCAAGAAAAATGGGAATGACTGAGGAA
GAAGCTCCATGTGGCCTGGAACTGTGGAGAGTCCTGAAACCAGCTGAGGCGGATGGAAGA
AGGCCAGTGCGGTTGTTATGGAAGAAGGCAAGAGGAGCCCCAGTCCTAGAGAAACACTT
GGCTACAACATATGGTACTATCCAGAAAGCAACACTAACCTCACAGAAACAATGAACACT
ACTAACCAGCAGCTTGAACTGCATCTGGGAGGCGAGAGCTTTTGGGTGTCTATGATTTCT
TATAATTCTCTTGGGAAGTCTCCAGTGGCCACCCTGAGGATTCCAGCTATTCAAGAAAAA
TCATTTCAGTGCATTGAGGTCATGCAGGCCTGCGTTGCTGAGGACCAGCTAGTGGTGAAG
TGGCAAAGCTCTGCTCTAGACGTGAACACTTGGATGATTGAATGGTTTCCGGATGTGGAC
TCAGAGCCCACCACCCTTTCCTGGGAATCTGTGTCTCAGGCCACGAACTGGACGATCCAG
CAAGATAAATTAAAACCTTTCTGGTGCTATAACATCTCTGTGTATCCAATGTTGCATGAC
AAAGTTGGCGAGCCATATTCCATCCAGGCTTATGCCAAAGAAGGCGTTCCATCAGAAGGT
CCTGAGACCAAGGTGGAGAACATTGGCGTGAAGACGGTCACGATCACATGGAAAGAGATT
CCCAAGAGTGAGAGAAAGGGTATCATCTGCAACTACACCATCTTTTACCAAGCTGAAGGT
GGAAAAGGATTCTGTAAGCACGCCCATAGCGAAGTGGAAAAAAACCCCAAGCCCCAGATA
GATGCTATGGATAGACCTGTTGTAGGCATGGCTCCCCCATCTCATTGTGACTTGCAACCT
GGCATGAATCACTTAGCTTCTTTAAATCTCTCTGAAAATGGGGCCAAGAGCACCCACCTT
TTGGGGTTTTGGGGGTTAAATGAGAGTGAAGTGACAGTACCTGAGAGGAGAGTCCTGAGG
AAATGGAAGGAGTTGTTATAATTTGTCCTGGTTAGGCCCTGAATTGACCTCCCGGGAGCT
CCCCGACCATCATTCCCAGGAATGGCGTGCCTGGCTTAAAGAGTGAGGAGGAACAGACCC
TGTCACCATGACTTCTACTGCCCCTGCCAAATCATGCTTTTGTTTTTCAGTCCACCTTAT
CTCCTGACATCTTAAATACTGGGCAAGGCTTGGATTCTTGCTTAGGCTAAATAATTTTTT
CTTATGGTAAAATACACGTAAATATTTTTCCAGTTTAAACATTTGAAAGTGTACAATTT
AGTGGCATTAGAAGCATTCACAATATTGTGCAACCATCACCACTATTTCCAGAACTCTTC
TATTTCTGCCCAAATAGAAGCCCTATACCCATTCATTAGTCACTCCCCATTCCTCTCCTC
CCACAGCCCCTGGCAACTACCAAACTGCTTTGTGTCTCTATGGATTGCCTATTTTGGATA
TTTCATATACATAGAATCATAAANTAAAAAAAAAAAAAAAAAAAA
```

FIGURE 372

```
MCIRQLKFFTTACVCECPQNILSPQPSCVNLGMMWTWALWMLPSLCKFSLAALPAKPENI
SCVYYYRKNLTCTWSPGKETSYTQYTVKRTYAFGEKHDNCTTNSSTSENRASCSFFLPRI
TIPDNYTIEVEAENGDGVIKSHMTYWRLENIAKTEPPKIFRVKPVLGIKRMIQIEWIKPE
LAPVSSDLKYTLRFRTVNSTSWMEVNFAKNRKDKNQTYNLTGLQPFTEYVIALRCAVKES
KFWSDWSQEKMGMTEEEAPCGLELWRVLKPAEADGRRPVRLLWKKARGAPVLEKTLGYNI
WYYPESNTNLTETMNTTNQQLELHLGGESFWVSMISYNSLGKSPVATLRIPAIQEKSFQC
IEVMQACVAEDQLVVKWQSSALDVNTWMIEWFPDVDSEPTTLSWESVSQATNWTIQQDKL
KPFWCYNISVYPMLHDKVGEPYSIQAYAKEGVPSEGPETKVENIGVKTVTITWKEIPKSE
RKGIICNYTIFYQAEGGKGFCKHAHSEVEKNPKPQIDAMDRPVVGMAPPSHCDLQPGMNH
LASLNLSENGAKSTHLLGFWGLNESEVTVPERRVLRKWKELL
```

Important features of the protein:

Signal peptide:
1-46

Transmembrane domain:
None

N-glycosylation site:
59-63, 69-73, 99-103, 103-107, 125-129, 198-202, 215-219, 219-223, 309-313, 315-319, 412-416, 427-431, 487-491, 545-549, 563-567

N-myristoylation site:
32-38, 137-143, 483-489, 550-556, 561-567

Amidation site:
274-278

Growth factor and cytokines receptors family signature 1:
62-75

Fibronectin type III domain:
54-144
154-247

FIGURE 373

CCAGGTCCAACTGCACCTCGGTTCTATCGATTGAATTCCCCGGGGATCCTCTAGAGATCC
CTCGACCTCGACCCACGCGTCCGCCAAGCTGGCCCTGCACGGCTGCAAGGGAGGCTCCTG
TGGACAGGCCAGGCAGGTGGGCCTCAGGAGGTGCCTCCAGGCGGCCAGTGGGCCTGAGGC
CCCAGCAAGGGCTAGGGTCCATCTCCAGTCCAGGACACAGCAGCGGCCACCATGGCCAC
GCCTGGGCTCCAGCAGCATCAGCAGCCCCAGGACCGGGGGAGGCACAGGTGGCCCCCAC
CACCCGGAGGAGCAGCTCCTGCCCCTGTCCGGGGATGACTGATTCTCCTCCGCCAGGCC
ACCCAGAGGAGAAGGCCACCCCGCCTGGAGGCACAGGCCATGAGGGGCTCTCAGGAGGTG
CTGCTGATGTGGCTTCTGGTGTTGGCAGTGGGCGGCACAGAGCACGCCTACCGGCCCGGC
CGTTAGGGTGTGTGCTGTCCCGGGCTCACGGGACCCTGTCTCCGAGTCGTTCGTGCAGC
GTGTGTACCAGCCCTTCCTCACCACCTGCGACGGGCACCGGGCCTGCAGCACCTACCGAA
CCATTTATAGGACCGCCTACCGCCGCAGCCCTGGGCTGGCCCCTGCCAGGCCTCGCTACG
CGTGCTGCCCCGGCTGGAAGAGGACCAGCGGGCTTCCTGGGGCCTGTGGAGCAGCAATAT
GCCAGCCGCCATGCCGGAACGGAGGGAGCTGTGTCCAGCCTGGCCGCTGCCGCTGCCCTG
CAGGATGGCGGGGTGACACTTGCCAGTCAGATGTGGATGAATGCAGTGCTAGGAGGGGCG
GCTGTCCCCAGCGCTGCATCAACACCGCCGGCAGTTACTGGTGCCAGTGTTGGGAGGGGC
ACAGCCTGTCTGCAGACGGTACACTCTGTGTGCCCAAGGGAGGGCCCCCAGGGTGGCCC
CCAACCCGACAGGAGTGGACAGTGCAATGAAGGAAGAAGTGCAGAGGCTGCAGTCCAGGG
TGGACCTGCTGGAGGAGAAGCTGCAGCTGGTGCTGGCCCCACTGCACAGCCTGGCCTCGC
AGGCACTGGAGCATGGGCTCCCGGACCCCGGCAGCCTCCTGGTGCACTCCTTCCAGCAGC
TCGGCCGCATCGACTCCCTGAGCGAGCAGATTTCCTTCCTGGAGGAGCAGCTGGGGTCCT
GCTCCTGCAAGAAAGACTCGTGACTGCCCAGCGCCCCAGGCTGGACTGAGCCCCTCACGC
CGCCCTGCAGCCCCCATGCCCCTGCCCAACATGCTGGGGGTCCAGAAGCCACCTCGGGGT
GACTGAGCGGAAGGCCAGGCAGGGCCTTCCTCCTTTTCCTCCTCCCCTTCCCTCGGGAGG
GTCCCCAGACCCTGGCATGGGATGGGCTGGATTTTTTTTGTGAATCCACCCCTGGCTAC
CCCCACCCTGGTTACCCCAACGGCATCCCAAGGCCAGGTGGGCCCTCAGCTGAGGGAAGG
TACGAGTTCCCCTGCTGGAGCCTGGGACCCATGGCACAGGCCAGGCAGCCCGGAGGCTGG
GTGGGGCCTCAGTGGGGCTGCTGCCTGACCCCAGCACAATAAAAATGAAACGTGAAAA
AAAAAAAAAAAAAAAAAAAAAAAAAAAAAAAAAAAAGGGCGGCCGCGACTCTAGAGTC
GACCTGCAGAAGCTTGGCCGCCATGGCCCAACTTGTTTATTGCAGCTTATAATGGTTACAAAT

FIGURE 374

```
MTDSPPPGHPEEKATPPGGTGHEGLSGGAADVASGVGSGRHRARLPARPLGCVLSRAHGD
PVSESFVQRVYQPFLTTCDGHRACSTYRTIYRTAYRRSPGLAPARPRYACCPGWKRTSGL
PGACGAAICQPPCRNGGSCVQPGRCRCPAGWRGDTCQSDVDECSARRGGCPQRCINTAGS
YWCQCWEGHSLSADGTLCVPKGGPPRVAPNPTGVDSAMKEEVQRLQSRVDLLEEKLQLVL
APLHSLASQALEHGLPDPGSLLVHSFQQLGRIDSLSEQISFLEEQLGSCSCKKDS
```

FIGURE 376
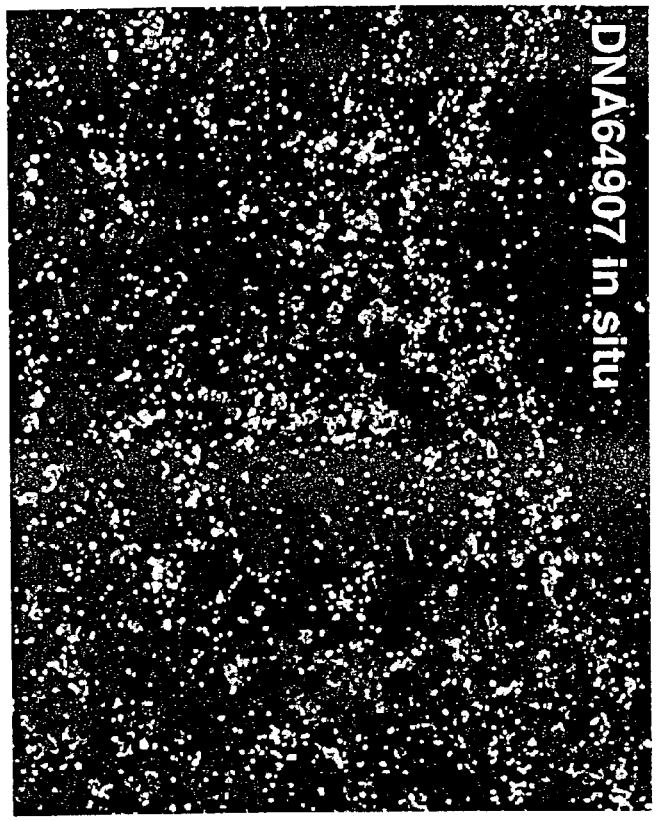
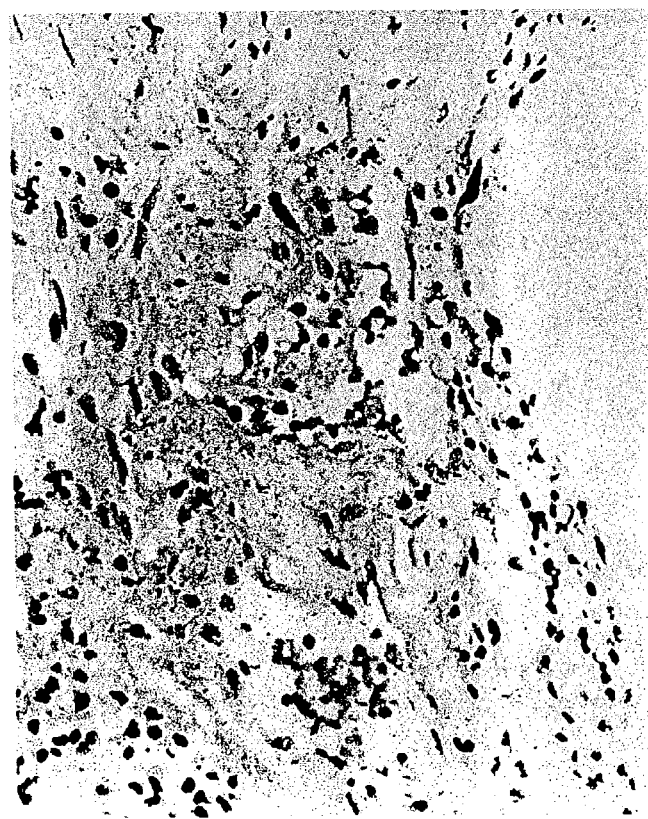
PRO1449 is expressed in vasculature of many inflamed and diseased tissues
Human tumor tissue (DF) — DNA64907 in situ
Human tumor tissue (BF)

Mouse orthologue of PRO1449 induces ectopic vessels in the eyes of chicken embryos

PRO9821 NUCLEIC ACIDS

RELATED APPLICATIONS

This is a continuation application claiming priority under 35 USC § 120 to U.S. application Ser. No. 10/081,056, filed Feb. 20, 2002, now abandoned which is a continuation of International application Number PCT/US01/21735, filed Jul. 9, 2001, which is a continuation-in-part of International application Number PCT/US01/19692, filed Jun. 20, 2001, which claims priority under 35 USC § 119 to U.S. provisional application Ser. No. 60/232,887, filed Sep. 15, 2000, the entire disclosures of which are hereby incorporated by reference.

FIELD OF THE INVENTION

The present invention relates to compositions and methods useful for the modulation (e.g., promotion or inhibition) of angiogenesis and/or cardiovascularization in mammals in need of such biological effect. The present invention further relates to the diagnosis and treatment of disorders involving angiogenesis (e.g., cardiovascular as well as oncological disorders).

BACKGROUND OF THE INVENTION 2.1. Angiogenesis

Angiogenesis, defined as the growth or sprouting of new blood vessels from existing vessels, is a complex process that primarily occurs during embryonic development. Under normal physiological conditions in adults, angiogenesis takes place only in very restricted situations such as hair growth and wounding healing (Auerbach, W. and Auerbach, R., 1994, *Pharmacol Ther* 63(3):265–311; Ribatti et al., 1991, *Haematologica* 76(4):311–20; Risau, 1997, *Nature* 386(6626):671–4). Unregulated angiogenesis has gradually been recognized to be responsible for a wide range of disorders, including, but not limited to cardiovascular disease, cancer, rheumatoid arthritis, psoriasis and diabetic retinopathy (Folkman, 1995, *Nat Med* 1(1):27–31; Isner, 1999, *Circulation* 99(13): 1653–5; Koch, 1998, *Arthritis Rheum* 41(6):951–62; Walsh, 1999, *Rheumatology (Oxford)* 38(2): 103–12; Ware and Simons, 1997, *Nat Med* 3(2): 158–64).

2.2. Cardiac Disorders and Factors

Heart failure affects approximately five million Americans, and new cases of heart failure number about 400,000 each year. It is the single most frequent cause of hospitalization for people age 65 and older in the United States. Recent advances in the management of acute cardiac diseases, including acute myocardial infarction, are resulting in an expanding patient population that will eventually develop chronic heart failure. From 1979 to 1995, hospitalizations for congestive heart failure (CHF) rose from 377,000 to 872,000 (a 130 percent increase) and CHF deaths increased 116 percent.

CHF is a syndrome characterized by left ventricular dysfunction, reduced exercise tolerance, impaired quality of life, and markedly shortened life expectancy. The sine qua non of heart failure is an inability of the heart to pump blood at a rate sufficient to meet the metabolic needs of the body's tissues (in other words, there is insufficient cardiac output).

At least four major compensatory mechanisms are activated in the setting of heart failure to boost cardiac output, including peripheral vasoconstriction, increased heart rate, increased cardiac contractility, and increased plasma volume. These effects are mediated primarily by the sympathetic nervous system and the renin-angiotensin system. See, Eichhorn, *American Journal of Medicine*, 104: 163–169 (1998). Increased output from the sympathetic nervous system increases vascular tone, heart rate, and contractility. Angiotensin II elevates blood pressure by 1) directly stimulating vascular smooth muscle contraction, 2) promoting plasma volume expansion by stimulating aldosterone and antidiuretic hormone secretion, 3) stimulating sympathetic-mediated vascular tone, and 4) catalyzing the degradation of bradykinin, which has vasodilatory and natriuretic activity. See, review by Brown and Vaughan, *Circulation*, 97: 1411–1420 (1998). As noted below, angiotensin II may also have directly deleterious effects on the heart by promoting myocyte necrosis (impairing systolic function) and intracardiac fibrosis (impairing diastolic and in some cases systolic function). See, Weber, *Circulation*, 96: 4065–4082 (1998).

A consistent feature of congestive heart failure (CHF) is cardiac hypertrophy, an enlargement of the heart that is activated by both mechanical and hormonal stimuli and enables the heart to adapt to demands for increased cardiac output. Morgan and Baker, *Circulation*, 83: 13–25 (1991). This hypertrophic response is frequently associated with a variety of distinct pathological conditions such as hypertension, aortic stenosis, myocardial infarction, cardiomyopathy, valvular regurgitation, and intracardiac shunt, all of which result in chronic hemodynamic overload.

Hypertrophy is generally defined as an increase in size of an organ or structure independent of natural growth that does not involve tumor formation. Hypertrophy of the heart is due either to an increase in the mass of the individual cells (myocytes), or to an increase in the number of cells making up the tissue (hyperplasia), or both.

While the enlargement of an embryonic heart is largely dependent on an increase in myocyte number (which continues until shortly after birth), post-natal cardiac myocytes lose their proliferative capacity. Further growth occurs through hypertrophy of the individual cells.

Adult myocyte hypertrophy is initially beneficial as a short term response to impaired cardiac function by permitting a decrease in the load on individual muscle fibers. With severe, long-standing overload, however, the hypertrophied cells begin to deteriorate and die. Katz, "Heart Failure", in: Katz A. M. ed., *Physiology of the Heart* (New York: Raven Press, 1992) pp.638–668. Cardiac hypertrophy is a significant risk factor for both mortality and morbidity in the clinical course of heart failure. Katz, *Trends Cardiovasc. Med.*, 5: 37–44 (1995). For further details of the causes and pathology of cardiac hypertrophy see, e.g., *Heart Disease, A Textbook of Cardiovascular Medicine*, Braunwald, E. ed. (W.B. Saunders Co., 1988), Chapter 14, "Pathophysiology of Heart Failure."

On a cellular level, the heart is composed of myocytes and surrounding support cells, generically called non-myocytes. While non-myocytes are primarily fibroblast/mesenchymal cells, they also include endothelial and smooth muscle cells. Indeed, although myocytes make up most of the adult myocardial mass, they represent only about 30% of the total cell numbers present in heart. In response to hormonal, physiological, hemodynamic, and pathological stimuli, adult ventricular muscle cells can adapt to increased workloads through the activation of a hypertrophic process. This response is characterized by an increase in myocyte cell size and contractile protein content of individual cardiac muscle cells, without concomitant cell division and activation of embryonic genes, including the gene for atrial natriuretic peptide (ANP). Chien et al., *FASEB J.*, 5: 3037–3046 (1991); Chien et al., *Annu. Rev. Physiol.*, 55: 77–95 (1993). An increment in myocardial mass as a result of an increase in myocyte size that is associated with an accumulation of interstitial collagen within the extracellular matrix and around intramyocardial coronary arteries has been described in left ventricular hypertrophy secondary to pressure overload in humans. Caspari et al., *Cardiovasc. Res.*, 11: 554–558 (1977); Schwarz et al., *Am. J. Cardiol.*, 42: 895–903 (1978); Hess et al., *Circulation*, 63: 360–371 (1981); Pearlman et al., *Lab. Invest.*, 46: 158–164 (1982).

It has also been suggested that paracrine factors produced by non-myocyte supporting cells may additionally be involved in the development of cardiac hypertrophy, and various non-myocyte derived hypertrophic factors, such as, leukocyte inhibitory factor (LIF) and endothelin, have been identified. Metcalf, *Growth Factors*, 7: 169–173 (1992); Kurzrock et al., *Endocrine Reviews*, 12: 208–217 (1991); Inoue et al., *Proc. Natl. Acad. Sci. USA*, 86: 2863–2867 (1989); Yanagisawa and Masaki, *Trends Pharm. Sci.*, 10: 374–378 (1989); U.S. Pat. No. 5,573,762 (issued Nov. 12, 1996). Further exemplary factors that have been identified as potential mediators of cardiac hypertrophy include cardiotrophin-1 (CT-1) (Pennica et al., *Proc. Nat. Acad. Sci. USA*, 92: 1142–1146 (1995)), catecholamines, adrenocorticosteroids, angiotensin, and prostaglamidins.

At present, the treatment of cardiac hypertrophy varies depending on the underlying cardiac disease.

Catecholamines, adrenocorticosteroids, angiotensin, prostaglamidins, LIF, endothelin (including endothelin-1, -2, and -3 and big endothelin), and CT-1 are among the factors identified as potential mediators of hypertrophy. For example, beta-adrenergic receptor blocking drugs (beta-blockers, e.g., propranolol, timolol, tertalolol, carteolol, nadolol, betaxolol, penbutolol, acetobutolol, atenolol, metoprolol, carvedilol, etc.) and verapamil have been used extensively in the treatment of hypertrophic cardiomyopathy. The beneficial effects of beta-blockers on symptoms (e.g., chest pain) and exercise tolerance are largely due to a decrease in the heart rate with a consequent prolongation of diastole and increased passive ventricular filling. Thompson et al., *Br. Heart J.*, 44: 488–98 (1980); Harrison et al., *Circulation*, 29: 84–98 (1964). Verapamil has been described to improve ventricular filling and probably reducing myocardial ischemia. Bonow et al., *Circulation*, 72: 853–64 (1985).

Nifedipine and diltiazem have also been used occasionally in the treatment of hypertrophic cardiomyopathy. Lorell et al., *Circulation*, 65: 499–507 (1982); Betocchi et al., *Am. J. Cardiol.*, 78: 451–457 (1996). However, because of its potent vasodilating properties, nifedipine may be harmful, especially in patients with outflow obstruction. Disopyramide has been used to relieve symptoms by virtue of its negative inotropic properties. Pollick, *N. Engl. J. Med.*, 307: 997–999 (1982). In many patients, however, the initial benefits decrease with time. Wigle et al., *Circulation*, 92: 1680–1692 (1995). Antihypertensive drug therapy has been reported to have beneficial effects on cardiac hypertrophy associated with elevated blood pressure. Examples of drugs used in antihypertensive therapy, alone or in combination, are calcium antagonists, e.g., nitrendipine; adrenergic receptor blocking agents, e.g., those listed above; angiotensin converting enzyme (ACE) inhibitors such as quinapril, captopril, enalapril, ramipril, benazepril, fosinopril, and lisinopril; diuretics, e.g., chlorothiazide, hydrochlorothiazide, hydroflumethazide, methylchlothiazide, benzthiazide, dichlorphenamide, acetazolamide, and indapamide; and calcium channel blockers, e.g., diltiazem, nifedipine, verapamil, and nicardipine.

For example, treatment of hypertension with diltiazem and captopril showed a decrease in left ventricular muscle mass, but the Doppler indices of diastolic function did not normalize. Szlachcic et al., *Am. J. Cardiol.*, 63: 198–201 (1989); Shahi et al., *Lancet*, 336: 458–461 (1990). These findings were interpreted to indicate that excessive amounts of interstitial collagen may remain after regression of left ventricular hypertrophy. Rossi et al., *Am. Heart J.*, 124: 700–709 (1992). Rossi et al., supra, investigated the effect of captopril on the prevention and regression of myocardial cell hypertrophy and interstitial fibrosis in pressure overload cardiac hypertrophy, in experimental rats.

Agents that increase cardiac contractility directly (iontropic agents) were initially thought to benefit patients with heart failure because they improved cardiac output in the short term. However, all positive inotropic agents except digoxigenin have been found to result in increased long-term mortality, in spite of short-term improvements in cardiac performance. Massie, *Curr. Op. in Cardiology*, 12: 209–217 (1997); Reddy et al., *Curr. Opin. Cardiol*, 12: 233–241 (1997). Beta-adrenergic receptor blockers have recently been advocated for use in heart failure. Evidence from clinical trials suggests that improvements in cardiac function can be achieved without increased mortality, though documented improvements of patient survival have not yet been demonstrated. See also, U.S. Pat. Nos. 5,935,924, 5,624,806; 5,661,122; and 5,610,134 and WO 95/28173 regarding the use of cardiotropin-1 or antagonists thereof, or growth hormone and/or insulin-like growth factor-I in the treatment of CHF. Another treatment modality is heart transplantation, but this is limited by the availability of donor hearts.

Endothelin is a vasoconstricting peptide comprising 21 amino acids, isolated from swine arterial endothelial culture supernatant and structurally determined. Yanagisawa et al., *Nature*, 332: 411–415 (1988). Endothelin was later found to exhibit various actions, and endothelin antibodies as endothelin antagonists have proven effective in the treatment of myocardial infarction, renal failure, and other diseases. Since endothelin is present in live bodies and exhibits vasoconstricting action, it is expected to be an endogenous factor involved in the regulation of the circulatory system, and may be associated with hypertension, cardiovascular diseases such as myocardial infarction, and renal diseases such as acute renal failure. Endothelin antagonists are described, for example, in U.S. Pat. No. 5,773,414; JP Pat. Publ. 3130299/1991, EP 457,195; EP 460,679; and EP 552,489. A new endothelin B receptor for identifying endothelin receptor antagonists is described in U.S. Pat. No. 5,773,223.

Current therapy for heart failure is primarily directed to using angiotensin-converting enzyme (ACE) inhibitors, such as captopril, and diuretics. These drugs improve hemodynamic profile and exercise tolerance and reduce the incidence of morbidity and mortality in patients with CHF. Kramer et al., *Circulation*, 67(4): 807–816 (1983); Captopril Multicenter Research Group, *J.A.C.C.*, 2(4): 755–763 (1983); The CONSENSUS Trial Study Group, *N. Engl. J. Med.*, 316(23): 1429–1435 (1987); The SOLVD Investigators, *N. Engl. J. Med.*, 325(5):293–302 (1991). Further, they are useful in treating hypertension, left ventricular dysfunction, atherosclerotic vascular disease, and diabetic nephropathy. Brown and Vaughan, supra. However, despite proven efficacy, response to ACE inhibitors has been limited. For example, while prolonging survival in the setting of heart failure, ACE inhibitors appear to slow the progression towards end-stage heart failure, and substantial numbers of patients on ACE inhibitors have functional class III heart failure.

Moreover, improvement of functional capacity and exercise time is only small and mortality, although reduced, continues to be high. The CONSENSUS Trial Study Group, *N. Engl. J. Med.*, 316(23): 1429–1453(1987); The SOLVD Investigators, *N. Engl. J. Med.*, 325(5):293–302(1991); Cohn et al., *N. Engl. J. Med.*, 325(5):303–310 (1991); The Captopril-Digoxin Multicenter Research Group, *JAMA*, 259 (4): 539–544 (1988). Hence, ACE inhibitors consistently appear unable to relieve symptoms in more than 60% of heart failure patients and reduce mortality of heart failure only by approximately 15–20%. For further adverse effects, see Brown and Vaughan, supra.

An alternative to ACE inhibitors is represented by specific AT1 receptor antagonists. Clinical studies are planned to compare the efficacy of these two modalities in the treatment of cardiovascular and renal disease. However, animal model data suggests that the ACE/Ang II pathway, while clearly involved in cardiac hypertrophy, is not the only, or even the primary pathway active in this role. Mouse genetic "knockout" models have been made to test individual components of the pathway. In one such model, the primary cardiac receptor for Ang II, AT sub 1A, has been genetically deleted; these mice do not develop hypertrophy when Ang II is given experimentally (confirming the basic success of the model in eliminating hypertrophy secondary to Ang II). However, when the aorta is constricted in these animals (a model of hypertensive cardiac stress), the hearts still become hypertrophic. This suggests that alternative signaling pathways, not depending on this receptor (AT sub 1A), are activated in hypertension. ACE inhibitors would presumably not be able to inhibit these pathways. See, Harada et al., *Circulation*, 97: 1952–1959 (1998). See also, Homcy, *Circulation*, 97: 1890–1892 (1998) regarding the enigma associated with the process and mechanism of cardiac hypertrophy.

About 750,000 patients suffer from acute myocardial infarction (AMI) annually, and approximately one-fourth of all deaths in the United States are due to AMI. In recent years, thrombolytic agents, e.g., streptokinase, urokinase, and in particular tissue plasminogen activator (t-PA) have significantly increased the survival of patients who suffered myocardial infarction. When administered as a continuous intravenous infusion over 1.5 to 4 hours, t-PA produces coronary patency at 90 minutes in 69% to 90% of the treated patients. Topol et al., *Am. J. Cardiol.*, 61: 723–728 (1988); Neuhaus et al., *J. Am. Coll. Cardiol.*, 12: 581–587 (1988); Neuhaus et al., *J. Am. Coll. Cardiol.*, 14: 1566–1569 (1989). The highest patency rates have been reported with high dose or accelerated dosing regimens. Topol, *J. Am. Coll. Cardiol.*, 15: 922–924 (1990). t-PA may also be administered as a single bolus, although due to its relatively short half-life, it is better suited for infusion therapy. Tebbe et al., *Am. J. Cardiol.*, 64: 448–453 (1989). A t-PA variant, specifically designed to have longer half-life and very high fibrin specificity, TNK t-PA (a T103N, N117Q, KHRR(296–299)AAAA t-PA variant, Keyt et al., *Proc. Natl. Acad. Sci. USA*, 91: 3670–3674 (1994)) is particularly suitable for bolus administration. However, despite all these advances, the long-term prognosis of patient survival depends greatly on the post-infarction monitoring and treatment of the patients, which should include monitoring and treatment of cardiac hypertrophy.

2.3. Growth Factors

Various naturally occurring polypeptides reportedly induce the proliferation of endothelial cells. Among those polypeptides are the basic and acidic fibroblast growth factors (FGF) (Burgess and Maciag, *Annual Rev. Biochem.*, 58: 575 (1989)), platelet-derived endothelial cell growth factor(PD-ECGF) (Ishikawa et al., *Nature*, 338: 557 (1989)), and vascular endothelial growth factor (VEGF). Leung et al., *Science*, 246: 1306 (1989); Ferrara and Henzel, *Biochem. Biophys. Res. Commun.*, 161: 851 (1989); Tischer et al., *Biochem. Biophys. Res. Commun.*, 165: 1198 (1989); EP 471,754B granted Jul. 31, 1996.

Media conditioned by cells transfected with the human VEGF (hVEGF) cDNA promoted the proliferation of capillary endothelial cells, whereas control cells did not. Leung et al., *Science*, 246: 1306 (1989). Several additional cDNAs were identified in human cDNA libraries that encode 121-, 189-, and 206-amino acid isoforms of hVEGF (also collectively referred to as hVEGF-related proteins). The 121-amino acid protein differs from hVEGF by virtue of the deletion of the 44 amino acids between residues 116 and 159 in hVEGF. The 189-amino acid protein differs from hVEGF by virtue of the insertion of 24 amino acids at residue 116 in hVEGF, and apparently is identical to human vascular permeability factor (hVPF). The 206-amino acid protein differs from hVEGF by virtue of an insertion of 41 amino acids at residue 116 in hVEGF. Houck et al., *Mol. Endocrin.*, 5: 1806 (1991); Ferrara et al., *J. Cell. Biochem.*, 47: 211 (1991); Ferrara et al., *Endocrine Reviews*, 13: 18 (1992); Keck et al., *Science*, 246: 1309 (1989); Connolly et al., *J. Biol. Chem.*, 264: 20017 (1989); EP 370,989 published May 30, 1990.

It is now well established that angiogenesis, which involves the formation of new blood vessels from preexisting endothelium, is implicated in the pathogenesis of a variety of disorders. These include solid tumors and metastasis, atherosclerosis, retrolental fibroplasia, hemangiomas, chronic inflammation, intraocular neovascular syndromes such as proliferative retinopathies, e.g., diabetic retinopathy, age-related macular degeneration (AMD), neovascular glaucoma, immune rejection of transplanted corneal tissue and other tissues, rheumatoid arthritis, and psoriasis. Folkman et al., *J. Biol. Chem.*, 267: 10931–10934 (1992); Klagsbrun et al., *Annu. Rev. Physiol.*, 53: 217–239 (1991); and Garner A., "Vascular diseases", In: *Pathobiology of Ocular Disease. A Dynamic Approach*, Garner A., Klintworth G K, eds., 2nd Edition (Marcel Dekker, NY, 1994), pp 1625–1710.

In the case of tumor growth, angiogenesis appears to be crucial for the transition from hyperplasia to neoplasia, and for providing nourishment for the growth and metastasis of the tumor. Folkman et al., *Nature*, 339: 58(1989). The neovascularization allows the tumor cells to acquire a growth advantage and proliferative autonomy compared to the normal cells. A tumor usually begins as a single aberrant cell which can proliferate only to a size of a few cubic millimeters due to the distance from available capillary beds, and it can stay 'dormant' without further growth and dissemination for a long period of time. Some tumor cells then switch to the angiogenic phenotype to activate endothelial cells, which proliferate and mature into new capillary blood vessels. These newly formed blood vessels not only allow for continued growth of the primary tumor, but also for the dissemination and recolonization of metastatic tumor cells. Accordingly, a correlation has been observed between density of microvessels in tumor sections and patient survival in breast cancer as well as in several other tumors. Weidner et al., *N. Engl. J. Med*, 324: 1–6 (1991); Horak et al., *Lancet*, 340: 1120–1124 (1992); Macchiarini et al., *Lancet*, 340: 145–146 (1992). The precise mechanisms that control the angiogenic switch is not well understood, but it is believed that neovascularization of tumor mass results from the net balance of a multitude of angiogenesis stimulators and inhibitors (Folkman, 1995, *Nat Med* 1(1):27–31).

The search for positive regulators of angiogenesis has yielded many candidates, including aFGF, bFGF, TGF-α, TGF-β, HGF, TNF-α, angiogenin, IL-8, etc. Folkman et al., *J.B.C.*, supra, and Klagsbrun et al., supra. The negative regulators so far identified include thrombospondin (Good et al., *Proc. Natl. Acad. Sci. USA.*, 87: 6624–6628 (1990)), the 16-kilodalton N-terminal fragment of prolactin (Clapp et al., *Endocrinology*, 133: 1292–1299 (1993)), angiostatin (O'Reilly et al., *Cell*, 79: 315–328 (1994)), and endostatin. O'Reilly et al., *Cell*, 88: 277–285 (1996).

Work done over the last several years has established the key role of VEGF, not only in stimulating vascular endothelial cell proliferation, but also in inducing vascular permeability and angiogenesis. Ferrara et al., *Endocr. Rev.*, 18: 4–25 (1997). The finding that the loss of even a single VEGF allele results in embryonic lethality points to an irreplaceable role played by this factor in the development and differentiation of the vascular system. Furthermore, VEGF has been shown to be a key mediator of neovascularization associated with tumors and intraocular disorders. Ferrara et al., *Endocr. Rev.*, supra. The VEGF mRNA is overexpressed by the majority of human tumors examined. Berkman et al., *J. Clin. Invest.*, 91: 153–159 (1993); Brown et al., *Human Pathol.*, 26: 86–91 (1995); Brown et al., *Cancer Res.*, 53: 4727–4735 (1993); Mattern et al., *Brit. J. Cancer*, 73: 931–934 (1996); Dvorak et al., *Am. J. Pathol.*, 146: 1029–1039 (1995).

Also, the concentration levels of VEGF in eye fluids are highly correlated to the presence of active proliferation of blood vessels in patients with diabetic and other ischemia-related retinopathies. Aiello et al., *N. Engl. J. Med.*, 331: 1480–1487 (1994). Furthermore, recent studies have demonstrated the localization of VEGF in choroidal neovascular membranes in patients affected by AMD. Lopez et al., *Invest. Ophthalmol. Vis. Sci.*, 37: 855–868 (1996).

Anti-VEGF neutralizing antibodies suppress the growth of a variety of human tumor cell lines in nude mice (Kim et al., *Nature*, 362: 841–844 (1993); Warren et al., *J. Clin. Invest.*, 95: 1789–1797 (1995); Borgström et al., *Cancer Res.*, 56: 4032–4039 (1996); Melnyk et al., *Cancer Res.*, 56: 921–924 (1996)) and also inhibit intraocular angiogenesis in models of ischemic retinal disorders. Adamis et al., *Arch. Ophthalmol.*, 114: 66–71 (1996). Therefore, anti-VEGF monoclonal antibodies or other inhibitors of VEGF action are promising candidates for the treatment of solid tumors and various intraocular neovascular disorders. Such antibodies are described, for example, in EP 817,648 published Jan. 14, 1998 and in WO98/45331 and WO98/45332 both published Oct. 15, 1998.

There exist several other growth factors and mitogens, including transforming oncogenes, that are capable of rapidly inducing a complex set of genes to be expressed by certain cells. Lau and Nathans, *Molecular Aspects of Cellular Regulation*, 6: 165–202 (1991). These genes, which have been named immediate-early- or early-response genes, are transcriptionally activated within minutes after contact with a growth factor or mitogen, independent of de novo protein synthesis. A group of these intermediate-early genes encodes secreted, extracellular proteins that are needed for coordination of complex biological processes such as differentiation and proliferation, regeneration, and wound healing. Ryseck et al., *Cell Growth Differ.*, 2: 235–233 (1991).

Highly-related proteins that belong to this group include cef 10 (Simmons et al., *Proc. Natl. Acad. Sci. USA*, 86: 1178–1182 (1989)), cyr 61, which is rapidly activated by serum- or platelet-derived growth factor (PDGF) (O'Brien et al., *Mol. Cell Biol.*, 10: 3569–3577 (1990), human connective tissue growth factor (CTGF) (Bradham et al., *J. Cell. Biol.*, 114: 1285–1294 (1991)), which is secreted by human vascular endothelial cells in high levels after activation with transforming growth factor beta (TGF-β), exhibits PDGF-like biological and immunological activities, and competes with PDGF for a particular cell surface receptor, fisp-12 (Ryseck et al., *Cell Growth Differ.*, 2: 235–233 (1991)), human vascular IBP-like growth factor (VIGF) (WO 96/17931), and nov, normally arrested in adult kidney cells, which was found to be overexpressed in myeloblastosis-associated-virus-type-1-induced nephroblastomas. Joloit et al., *Mol. Cell. Biol.*, 12: 10–21 (1992).

The expression of these immediate-early genes acts as "third messengers" in the cascade of events triggered by growth factors. It is also thought that they are needed to integrate and coordinate complex biological processes, such as differentiation and wound healing in which cell proliferation is a common event.

As additional mitogens, insulin-like growth factor binding proteins (IGFBPs) have been shown, in complex with insulin-like growth factor (IGF), to stimulate increased binding of IGF to fibroblast and smooth muscle cell surface receptors. Clemmons et al., *J. Clin. Invest.*, 77: 1548 (1986). Inhibitory effects of IGFBP on various IGF actions in vitro include stimulation of glucose transport by adipocytes, sulfate incorporation by chondrocytes, and thymidine incorporation in fibroblast. Zapf et al., *J. Clin. Invest*, 63: 1077 (1979). In addition, inhibitory effects of IGFBPs on growth factor-mediated mitogen activity in normal cells have been shown.

2.4. Need for Further Treatments

In view of the role of vascular endothelial cell growth and angiogenesis in many diseases and disorders, it is desirable to have a means of reducing or inhibiting one or more of the biological effects causing these processes. It is also desirable to have a means of assaying for the presence of pathogenic polypeptides in normal and diseased conditions, and especially cancer. Further, in a specific aspect, as there is no generally applicable therapy for the treatment of cardiac hypertrophy, the identification of factors that can prevent or reduce cardiac myocyte hypertrophy is of primary importance in the development of new therapeutic strategies to inhibit pathophysiological cardiac growth. While there are several treatment modalities for various cardiovascular and oncologic disorders, there is still a need for additional therapeutic approaches.

3. SUMMARY OF THE INVENTION

The present invention provides compositions and methods for modulating (e.g., promoting or inhibiting) angiogenesis and/or cardiovascularization in mammals. The present invention is based on the identification of compounds (i.e., proteins) that test positive in various cardiovascular assays that test modulation (e.g., promotion or inhibition) of certain biological activities. Accordingly, the compounds are believed to be useful drugs and/or drug components for the diagnosis and/or treatment (including prevention and amelioration) of disorders where such effects are desired, such as the promotion or inhibition of angiogenesis, inhibition or stimulation of vascular endothelial cell growth, stimulation of growth or proliferation of vascular endothelial cells, inhibition of tumor growth, inhibition of angiogenesis-dependent tissue growth, stimulation of angiogenesis-dependent tissue growth, inhibition of cardiac hypertrophy and stimulation of cardiac hypertrophy, e.g., for the treatment of congestive heart failure. In addition, the compositions and methods of the invention provide for the diagnostic monitoring of patients undergoing clinical evaluation for the treatment of angiogenesis-related disorders, for monitoring the efficacy of compounds in clinical trials and for identifying subjects who may be predisposed to such angiogenic-related disorders.

In one embodiment, the present invention provides a composition comprising a PRO polypeptide, an agonist or antagonist thereof, or an anti-PRO antibody in admixture with a pharmaceutically acceptable carrier. In one aspect, the composition comprises a therapeutically effective amount of the polypeptide, agonist, antagonist or antibody. In another aspect, the composition comprises a further active ingredient, namely, a cardiovascular, endothelial or angiogenic agent or an angiostatic agent, preferably an angiogenic or angiostatic agent. Preferably, the composition is sterile. The PRO polypeptide, agonist, antagonist or antibody may be administered in the form of a liquid pharmaceutical formulation, which may be preserved to achieve extended storage stability. Preserved liquid pharmaceutical formulations might contain multiple doses of PRO polypeptide, agonist, antagonist or antibody, and might, therefore, be suitable for repeated use. In a preferred embodiment, where the composition comprises an antibody, the antibody is a monoclonal antibody, an antibody fragment, a humanized antibody, or a single-chain antibody.

In a further embodiment, the present invention provides a method for preparing such a composition useful for the treatment of a cardiovascular, endothelial or angiogenic disorder comprising admixing a therapeutically effective amount of a PRO polypeptide, agonist, antagonist or antibody with a pharmaceutically acceptable carrier.

In a still further aspect, the present invention provides an article of manufacture comprising:

(a) a composition of matter comprising a PRO polypeptide or agonist or antagonist thereof;

(b) a container containing said composition; and (c) a label affixed to said container, or a package insert included in said container referring to the use of said PRO polypeptide or agonist or antagonist thereof in the treatment of a cardiovascular, endothelial or angiogenic disorder, wherein the agonist or antagonist may be an antibody which binds to the PRO polypeptide. The composition may comprise a therapeutically effective amount of the PRO polypeptide or the agonist or antagonist thereof.

In another embodiment, the present invention provides a method for identifying an agonist of a PRO polypeptide comprising:

(a) contacting cells and a test compound to be screened under conditions suitable for the induction of a cellular response normally induced by a PRO polypeptide; and (b) determining the induction of said cellular response to determine if the test compound is an effective agonist, wherein the induction of said cellular response is indicative of said test compound being an effective agonist.

In another embodiment, the present invention provides a method for identifying an agonist of a PRO polypeptide comprising:

(a) contacting cells and a test compound to be screened under conditions suitable for the stimulation of cell proliferation by a PRO polypeptide; and (b) measuring the proliferation of said cells to determine if the test compound is an effective agonist, wherein the stimulation of cell proliferation is indicative of said test compound being an effective agonist.

In another embodiment, the invention provides a method for identifying a compound that inhibits the activity of a PRO polypeptide comprising contacting a test compound with a PRO polypeptide under conditions and for a time sufficient to allow the test compound and polypeptide to interact and determining whether the activity of the PRO polypeptide is inhibited. In a specific preferred aspect, either the test compound or the PRO polypeptide is immobilized on a solid support. In another preferred aspect, the non-immobilized component carries a detectable label. In a preferred aspect, this method comprises the steps of:

(a) contacting cells and a test compound to be screened in the presence of a PRO polypeptide under conditions suitable for the induction of a cellular response normally induced by a PRO polypeptide; and (b) determining the induction of said cellular response to determine if the test compound is an effective antagonist.

In another preferred aspect, this process comprises the steps of:

(a) contacting cells and a test compound to be screened in the presence of a PRO polypeptide under conditions suitable for the stimulation of cell proliferation by a PRO polypeptide; and (b) measuring the proliferation of the cells to determine if the test compound is an effective antagonist.

In another embodiment, the invention provides a method for identifying a compound that inhibits the expression of a PRO polypeptide in cells that normally expresses the polypeptide, wherein the method comprises contacting the cells with a test compound and determining whether the expression of the PRO polypeptide is inhibited. In a preferred aspect, this method comprises the steps of:

(a) contacting cells and a test compound to be screened under conditions suitable for allowing expression of the PRO polypeptide; and (b) determining the inhibition of expression of said polypeptide.

In a still further embodiment, the invention provides a compound that inhibits the expression of a PRO polypeptide, such as a compound that is identified by the methods set forth above.

Another aspect of the present invention is directed to an agonist or an antagonist of a PRO polypeptide which may optionally be identified by the methods described above.

One type of antagonist of a PRO polypeptide that inhibits one or more of the functions or activities of the PRO polypeptide is an antibody. Hence, in another aspect, the invention provides an isolated antibody that binds a PRO polypeptide. In a preferred aspect, the antibody is a monoclonal antibody, which preferably has non-human complementarity-determining-region (CDR) residues and human framework-region (FR) residues. The antibody may be labeled and may be immobilized on a solid support. In a further aspect, the antibody is an antibody fragment, a single-chain antibody, or a humanized antibody. Preferably, the antibody specifically binds to the polypeptide.

In a still further aspect, the present invention provides a method for diagnosing a disease or susceptibility to a disease which is related to a mutation in a PRO polypeptide-encoding nucleic acid sequence comprising determining the presence or absence of said mutation in the PRO polypeptide nucleic acid sequence, wherein the presence or absence of said mutation is indicative of the presence of said disease or susceptibility to said disease.

In a still further aspect, the invention provides a method of diagnosing a cardiovascular, endothelial or angiogenic disorder in a mammal which comprises analyzing the level of expression of a gene encoding a PRO polypeptide (a) in a test sample of tissue cells obtained from said mammal, and (b) in a control sample of known normal tissue cells of the same cell type, wherein a higher or lower expression level in the test sample as compared to the control sample is indicative of the presence of a cardiovascular, endothelial or angiogenic disorder in said mammal. The expression of a gene encoding a PRO polypeptide may optionally be accomplished by measuring the level of mRNA or the polypeptide in the test sample as compared to the control sample.

In a still further aspect, the present invention provides a method of diagnosing a cardiovascular, endothelial or angiogenic disorder in a mammal which comprises detecting the presence or absence of a PRO polypeptide in a test sample of tissue cells obtained from said mammal, wherein the presence or absence of said PRO polypeptide in said test sample is indicative of the presence of a cardiovascular, endothelial or angiogenic disorder in said mammal.

In a still further embodiment, the invention provides a method of diagnosing a cardiovascular, endothelial or angiogenic disorder in a mammal comprising (a) contacting an anti-PRO antibody with a test sample of tissue cells obtained from the mammal, and (b) detecting the formation of a complex between the antibody and the PRO polypeptide in the test sample, wherein the formation of said complex is indicative of the presence of a cardiovascular, endothelial or angiogenic disorder in the mammal. The detection may be qualitative or quantitative, and may be performed in comparison with monitoring the complex formation in a control sample of known normal tissue cells of the same cell type. A larger or smaller quantity of complexes formed in the test sample indicates the presence of a cardiovascular, endothelial or angiogenic dysfunction in the mammal from which the test tissue cells were obtained. The antibody preferably carries a detectable label. Complex formation can be monitored, for example, by light microscopy, flow cytometry, fluorimetry, or other techniques known in the art. The test sample is usually obtained from an individual suspected to have a cardiovascular, endothelial or angiogenic disorder.

In another embodiment, the invention provides a method for determining the presence of a PRO polypeptide in a sample comprising exposing a sample suspected of containing the PRO polypeptide to an anti-PRO antibody and determining binding of said antibody to a component of said sample. In a specific aspect, the sample comprises a cell suspected of containing the PRO polypeptide and the antibody binds to the cell. The antibody is preferably detectably labeled and/or bound to a solid support.

In further aspects, the invention provides a cardiovascular, endothelial or angiogenic disorder diagnostic kit comprising an anti-PRO antibody and a carrier in suitable packaging. Preferably, such kit further comprises instructions for using said antibody to detect the presence of the PRO polypeptide. Preferably, the carrier is a buffer, for example. Preferably, the cardiovascular, endothelial or angiogenic disorder is cancer.

In yet another embodiment, the present invention provides a method for treating a cardiovascular, endothelial or angiogenic disorder in a mammal comprising administering to the mammal an effective amount of a PRO polypeptide. Preferably, the disorder is cardiac hypertrophy, trauma such as wounds or burns, or a type of cancer. In a further aspect, the mammal is further exposed to angioplasty or a drug that treats cardiovascular, endothelial or angiogenic disorders such as ACE inhibitors or chemotherapeutic agents if the cardiovascular, endothelial or angiogenic disorder is a type of cancer. Preferably, the mammal is human, preferably one who is at risk of developing cardiac hypertrophy and more preferably has suffered myocardial infarction.

In another preferred aspect, the cardiac hypertrophy is characterized by the presence of an elevated level of $PGF_{2\alpha}$. Alternatively, the cardiac hypertrophy may be induced by myocardial infarction, wherein preferably the administration of the PRO polypeptide is initiated within 48 hours, more preferably within 24 hours, following myocardial infarction.

In another preferred embodiment, the cardiovascular, endothelial or angiogenic disorder is cardiac hypertrophy and said PRO polypeptide is administered together with a cardiovascular, endothelial or angiogenic agent. The preferred cardiovascular, endothelial or angiogenic agent for this purpose is selected from the group consisting of an antihypertensive drug, an ACE inhibitor, an endothelin receptor antagonist and a thrombolytic agent. If a thrombolytic agent is administered, preferably the PRO polypeptide is administered following administration of such agent. More preferably, the thrombolytic agent is recombinant human tissue plasminogen activator.

In another preferred aspect, the cardiovascular, endothelial or angiogenic disorder is cardiac hypertrophy and the PRO polypeptide is administered following primary angioplasty for the treatment of acute myocardial infarction, preferably wherein the mammal is further exposed to angioplasty or a cardiovascular, endothelial, or angiogenic agent.

In another preferred embodiment, the cardiovascular, endothelial or angiogenic disorder is a cancer and the PRO polypeptide is administered in combination with a chemotherapeutic agent, a growth inhibitory agent or a cytotoxic agent.

In a further embodiment, the invention provides a method for treating a cardiovascular, endothelial or angiogenic disorder in a mammal comprising administering to the mammal an effective amount of a PRO polypeptide agonist, antagonist or anti-PRO antibody. Preferably, the cardiovascular, endothelial or angiogenic disorder is cardiac hypertrophy, trauma, a cancer, or age-related macular degeneration. Also preferred is where the mammal is human, and where an effective amount of an angiogenic or angiostatic agent is administered in conjunction with the agonist, antagonist or anti-PRO antibody.

In still further embodiments, the invention provides a method for treating a cardiovascular, endothelial or angiogenic disorder in a mammal that suffers therefrom comprising administering to the mammal a nucleic acid molecule that codes for either (a) a PRO polypeptide, (b) an agonist of a PRO polypeptide or (c) an antagonist of a PRO polypeptide, wherein said agonist or antagonist may be an anti-PRO antibody. In a preferred embodiment, the mammal is human. In another preferred embodiment, the gene is administered via ex vivo gene therapy. In a further preferred embodiment, the gene is comprised within a vector, more preferably an adenoviral, adeno-associated viral, lentiviral, or retroviral vector.

In yet another aspect, the invention provides a recombinant retroviral particle comprising a retroviral vector consisting essentially of a promoter, nucleic acid encoding (a) a PRO polypeptide, (b) an agonist polypeptide of a PRO polypeptide, or (c) an antagonist polypeptide of a PRO polypeptide, and a signal sequence for cellular secretion of the polypeptide, wherein the retroviral vector is in association with retroviral structural proteins. Preferably, the signal sequence is from a mammal, such as from a native PRO polypeptide.

In a still further embodiment, the invention supplies an ex vivo producer cell comprising a nucleic acid construct that expresses retroviral structural proteins and also comprises a retroviral vector consisting essentially of a promoter, nucleic acid encoding (a) a PRO polypeptide, (b) an agonist polypeptide of a PRO polypeptide or (c) an antagonist polypeptide of a PRO polypeptide, and a signal sequence for cellular secretion of the polypeptide, wherein said producer cell packages the retroviral vector in association with the structural proteins to produce recombinant retroviral particles.

In yet another embodiment, the invention provides a method for inhibiting endothelial cell growth in a mammal comprising administering to the mammal (a) a PRO polypeptide, (b) an agonist of a PRO polypeptide, or (c) an antagonist of a PRO polypeptide, wherein endothelial cell growth in said mammal is inhibited, and wherein said agonist or antagonist may be an anti-PRO antibody. Preferably, the mammal is human and the endothelial cell growth is associated with a tumor or a retinal disorder.

In yet another embodiment, the invention provides a method for stimulating endothelial cell growth in a mammal comprising administering to the mammal (a) a PRO polypeptide, (b) an agonist of a PRO polypeptide, or (c) an antagonist of a PRO polypeptide, wherein endothelial cell growth in said mammal is stimulated, and wherein said agonist or antagonist may be an anti-PRO antibody. Preferably, the mammal is human.

In yet another embodiment, the invention provides a method for inhibiting cardiac hypertrophy in a mammal comprising administering to the mammal (a) a PRO polypeptide, (b) an agonist of a PRO polypeptide, or (c) an antagonist of a PRO polypeptide, wherein cardiac hypertrophy in said mammal is inhibited, and wherein said agonist or antagonist may be an anti-PRO antibody. Preferably, the mammal is human and the cardiac hypertrophy has been induced by myocardial infarction.

In yet another embodiment, the invention provides a method for stimulating cardiac hypertrophy in a mammal comprising administering to the mammal (a) a PRO polypeptide, (b) an agonist of a PRO polypeptide, or (c) an antagonist of a PRO polypeptide, wherein cardiac hypertrophy in said mammal is stimulated, and wherein said agonist or antagonist may be an anti-PRO antibody. Preferably, the mammal is human who suffers from congestive heart failure.

In yet another embodiment, the invention provides a method for inhibiting angiogenesis induced by a PRO polypeptide in a mammal comprising administering a therapeutically effective amount of an anti-PRO antibody to the mammal. Preferably, the mammal is a human, and more preferably the mammal has a tumor or a retinal disorder.

In yet another embodiment, the invention provides a method for stimulating angiogenesis induced by a PRO polypeptide in a mammal comprising administering a therapeutically effective amount of a PRO polypeptide to the mammal. Preferably, the mammal is a human, and more preferably angiogenesis would promote tissue regeneration or wound healing.

In yet another embodiment, the invention provides a method for modulating (e.g., inhibiting or stimulating) endothelial cell growth in a mammal comprising administering to the mammal a PRO21, PRO181, PRO205, PRO214, PRO221, PRO229, PRO231, PRO238, PRO241, PRO247, PRO256, PRO258, PRO263, PRO265, PRO295, PRO321, PRO322, PRO337, PRO363, PRO365, PRO444, PRO533, PRO697, PRO720, PRO725, PRO771, PRO788, PRO791, PRO819, PRO827, PRO828, PRO836, PRO846, PRO865, PRO1005, PRO1006, PRO1007, PRO1025, PRO1029, PRO1054, PRO1071, PRO1075, PRO1079, PRO1080, PRO1114, PRO1131, PRO1155, PRO1160, PRO1184, PRO1186, PRO1190, PRO1192, PRO1195, PRO1244, PRO1272, PRO1273, PRO1274, PRO1279, PRO1283, PRO1286, PRO1306, PRO1309, PRO1325, PRO1329, PRO1347, PRO1356, PRO1376, PRO1382, PRO1411, PRO1412, PRO1419, PRO1474, PRO1477, PRO1488, PRO1508, PRO1550, PRO1556, PRO1760, PRO1782, PRO1787, PRO1801, PRO1868, PRO1887, PRO1890, PRO3438, PRO3444, PRO4302, PRO4324, PRO4333, PRO4341, PRO4342, PRO4353, PRO4354, PRO4356, PRO4371, PRO4405, PRO4408, PRO4422, PRO4425, PRO4499, PRO5723, PRO5725, PRO5737, PRO5776, PRO6006, PRO6029, PRO6071, PRO7436, PRO9771, PRO9821, PRO9873, PRO10008, PRO10096, PRO19670, PRO20040, PRO20044, PRO21055, PRO21384 or PRO28631 polypeptide, agonist or antagonist thereof, wherein endothelial cell growth in said mammal is modulated.

In yet another embodiment, the invention provides a method for modulating (e.g., inhibiting or stimulating) smooth muscle cell growth in a mammal comprising administering to the mammal a PRO162, PRO181, PRO182, PRO195, PRO204, PRO221, PRO230, PRO256, PRO258, PRO533, PRO697, PRO725, PRO738, PRO826, PRO836, PRO840, PRO846, PRO865, PRO982, PRO1025, PRO1029, PRO1071, PRO1080, PRO1083, PRO1134, PRO1160, PRO1182, PRO1184, PRO1186, PRO1192, PRO1265, PRO1274, PRO1279, PRO1283, PRO1306, PRO1308, PRO1309, PRO1325, PRO1337, PRO1338, PRO1343, PRO1376, PRO1387, PRO1411, PRO1412, PRO1415, PRO1434, PRO1474, PRO1488, PRO1550, PRO1556, PRO1567, PRO1600, PRO1754, PRO1758, PRO1760, PRO1787, PRO1865, PRO1868, PRO1917, PRO1928, PRO3438, PRO3562, PRO4302, PRO4333, PRO4345, PRO4353, PRO4354, PRO4405, PRO4408, PRO4430, PRO4503, PRO5725, PRO6714, PRO9771, PRO9820, PRO9940, PRO10096, PRO21055, PRO21184 or PRO21366 polypeptide, agonist or antagonist thereof, wherein endothelial cell growth in said mammal is modulated.

In yet another embodiment, the invention provides a method for modulating (e.g., inducing or reducing) cardiac hypertrophy in a mammal comprising administering to the mammal a PRO21 polypeptide, agonist or antagonist thereof, wherein cardiac hypertrophy in said mammal is modulated.

In yet another embodiment, the invention provides a method for modulating (e.g., inducing or reducing) endothelial cell apoptosis in a mammal comprising administering to the mammal a PRO4302 polypeptide, agonist or antagonist thereof, wherein cardiac hypertrophy in said mammal is modulated.

In yet another embodiment, the invention provides a method for modulating (e.g., stimulating or inhibiting) angiogenesis in a mammal comprising administering a therapeutically effective amount of a PRO1376 or PRO1449 polypeptide, agonist or antagonist thereof to the mammal, wherein said angiogenesis is modulated.

In yet another embodiment, the invention provides a method for modulating (e.g., inducing or reducing) angiogenesis by modulating (e.g., inducing or reducing) endothelial cell tube formation in a mammal comprising administering to the mammal a PRO178, PRO195, PRO228, PRO301, PRO302, PRO532, PRO724, PRO730, PRO734, PRO793, PRO871, PRO938, PRO1012, PRO1120, PRO1139, PRO1198, PRO1287, PRO1361, PRO1864, PRO1873, PRO2010, PRO3579, PRO4313, PRO4527, PRO4538, PRO4553, PRO4995, PRO5730, PRO6008, PRO7223, PRO7248 or PRO7261 polypeptide, agonist or antagonist thereof, wherein endothelial cell tube formation in said mammal is modulated.

In other embodiments of the present invention, the invention provides an isolated nucleic acid molecule comprising a nucleotide sequence that encodes a PRO polypeptide.

In one aspect, the isolated nucleic acid molecule comprises a nucleotide sequence having at least about 80%, 81%, 82%, 83%, 84%, 85%, 86%, 87%, 88%, 89%, 90%, 91%, 92%, 93%, 94%, 95%, 96%, 97% or 98% nucleic acid sequence identity and alternatively at least about 99% nucleic acid sequence identity to (a) a DNA molecule encoding a PRO polypeptide having a full-length amino acid sequence as disclosed herein, an amino acid sequence lacking the signal peptide as disclosed herein, an extracellular domain of a transmembrane protein, with or without the signal peptide, as disclosed herein or any other specifically defined fragment of the full-length amino acid sequence as disclosed herein, or (b) the complement of the DNA molecule of (a).

In other aspects, the isolated nucleic acid molecule comprises a nucleotide sequence having at least about 80%, 81%, 82%, 83%, 84%, 85%, 86%, 87%, 88%, 89%, 90%, 91%, 92%, 93%, 94%, 95%, 96%, 97% or 98% nucleic acid sequence identity and alternatively at least about 99% nucleic acid sequence identity to (a) a DNA molecule comprising the coding sequence of a full-length PRO polypeptide cDNA as disclosed herein, the coding sequence of a PRO polypeptide lacking the signal peptide as disclosed herein, the coding sequence of an extracellular domain of a transmembrane PRO polypeptide, with or without the signal peptide, as disclosed herein or the coding sequence of any other specifically defined fragment of the full-length amino acid sequence as disclosed herein, or (b) the complement of the DNA molecule of (a).

In a further aspect, the invention provides an isolated nucleic acid molecule comprising a nucleotide sequence having at least about 80%, 81%, 82%, 83%, 84%, 85%, 86%, 87%, 88%, 89%, 90%, 91%, 92%, 93%, 94%, 95%, 96%, 97% or 98% nucleic acid sequence identity and alternatively at least about 99% nucleic acid sequence identity to (a) a DNA molecule that encodes the same mature polypeptide encoded by any of the human protein cDNAs deposited with the ATCC as disclosed herein, or (b) the complement of the DNA molecule of (a).

Another aspect of the present invention provides an isolated nucleic acid molecule comprising a nucleotide sequence encoding a PRO polypeptide which is either transmembrane domain-deleted or transmembrane domain-inactivated, or is complementary to such encoding nucleotide sequence, wherein the transmembrane domain(s) of such polypeptide are disclosed herein. Therefore, soluble extracellular domains of the herein described PRO polypeptides are contemplated.

Another embodiment is directed to fragments of a PRO polypeptide coding sequence, or the complement thereof, that may find use as, for example, hybridization probes, for encoding fragments of a PRO polypeptide that may optionally encode a polypeptide comprising a binding site for an anti-PRO antibody or as antisense oligonucleotide probes. Such nucleic acid fragments are usually at least about 20, 30, 40, 50, 60, 70, 80, 90, 100, 110, 120, 130, 140, 150, 160, 170, 180, 190, 200, 250, 300, 350, 400, 450, 500, 600, 700 or 800 nucleotides in length and alternatively at least about 1000 nucleotides in length, wherein in this context the term "about" means the referenced nucleotide sequence length plus or minus 10% of that referenced length. It is noted that novel fragments of a PRO polypeptide-encoding nucleotide sequence may be determined in a routine manner by aligning the PRO polypeptide-encoding nucleotide sequence with other known nucleotide sequences using any of a number of well known sequence alignment programs and determining which PRO polypeptide-encoding nucleotide sequence fragment(s) are novel. All of such PRO polypeptide-encoding nucleotide sequences are contemplated herein. Also contemplated are the PRO polypeptide fragments encoded by these nucleotide molecule fragments, preferably those PRO polypeptide fragments that comprise a binding site for an anti-PRO antibody.

In another embodiment, the invention provides an isolated PRO polypeptide encoded by any of the isolated nucleic acid sequences hereinabove identified.

In a certain aspect, the invention provides an isolated PRO polypeptide comprising an amino acid sequence having at least about 80%, 81%, 82%, 83%, 84%, 85%, 86%, 87%, 88%, 89%, 90%, 91%, 92%, 93%, 94%, 95%, 96%, 97% or 98% amino acid sequence identity and alternatively at least about 99% amino acid sequence identity to a PRO polypeptide having a fill-length amino acid sequence as disclosed herein, an amino acid sequence lacking the signal peptide as disclosed herein, an extracellular domain of a transmembrane protein, with or without the signal peptide, as disclosed herein or any other specifically defined fragment of the full-length amino acid sequence as disclosed herein.

In a further aspect, the invention provides an isolated PRO polypeptide comprising an amino acid sequence having at least about 80%, 81%, 82%, 83%, 84%, 85%, 86%, 87%, 88%, 89%, 90%, 91%, 92%, 93%, 94%, 95%, 96%, 97% or 98% amino acid sequence identity and alternatively at least about 99% amino acid sequence identity to an amino acid sequence encoded by any of the human protein cDNAs deposited with the ATCC as disclosed herein.

In a specific aspect, the invention provides an isolated PRO polypeptide without the N-terminal signal sequence and/or the initiating methionine and that is encoded by a nucleotide sequence that encodes such an amino acid sequence as hereinbefore described. Processes for producing the same are also herein described, wherein those processes comprise culturing a host cell comprising a vector which comprises the appropriate encoding nucleic acid molecule under conditions suitable for expression of the PRO polypeptide and recovering the PRO polypeptide from the cell culture.

Another aspect of the invention provides an isolated PRO polypeptide which is either transmembrane domain-deleted or transmembrane domain-inactivated. Processes for producing the same are also herein described, wherein those processes comprise culturing a host cell comprising a vector which comprises the appropriate encoding nucleic acid molecule under conditions suitable for expression of the PRO polypeptide and recovering the PRO polypeptide from the cell culture.

In yet another embodiment, the invention provides agonists and antagonists of a native PRO polypeptide as defined herein. In a particular embodiment, the agonist or antagonist is an anti-PRO antibody or a small molecule.

In a further embodiment, the invention provides a method of identifying agonists or antagonists to a PRO polypeptide which comprise contacting the PRO polypeptide with a candidate molecule and monitoring a biological activity mediated by said PRO polypeptide. Preferably, the PRO polypeptide is a native PRO polypeptide.

In a still further embodiment, the invention provides a composition of matter comprising a PRO polypeptide, or an agonist or antagonist of a PRO polypeptide as herein described, or an anti-PRO antibody, in combination with a carrier. Optionally, the carrier is a pharmaceutically acceptable carrier.

Another embodiment of the present invention is directed to the use of a PRO polypeptide, or an agonist or antagonist thereof as hereinbefore described, or an anti-PRO antibody, for the preparation of a medicament useful in the treatment of a condition which is responsive to the PRO polypeptide, an agonist or antagonist thereof or an anti-PRO antibody.

In additional embodiments of the present invention, the invention provides vectors comprising DNA encoding any of the herein described polypeptides. Host cells comprising any such vector are also provided. By way of example, the host cells may be CHO cells, *E. coli*, yeast, or Baculovirus-infected insect cells. A process for producing any of the herein described polypeptides is further provided and comprises culturing host cells under conditions suitable for expression of the desired polypeptide and recovering the desired polypeptide from the cell culture.

In other embodiments, the invention provides chimeric molecules comprising any of the herein described polypeptides fused to a heterologous polypeptide or amino acid sequence. Example of such chimeric molecules comprise any of the herein described polypeptides fused to an epitope tag sequence or a Fc region of an immunoglobulin.

In yet another embodiment, the invention provides an antibody which specifically binds to any of the above or below described polypeptides. Optionally, the antibody is a monoclonal antibody, humanized antibody, antibody fragment or single-chain antibody.

In yet other embodiments, the invention provides oligonucleotide probes useful for isolating genomic and cDNA nucleotide sequences or as antisense probes, wherein those probes may be derived from any of the above or below described nucleotide sequences.

4. BRIEF DESCRIPTION OF THE DRAWINGS

FIG. 1 shows a nucleotide sequence (SEQ ID NO:1) of a native sequence PRO181 cDNA, wherein SEQ ID NO:1 is a clone designated herein as "DNA23330-1390".

FIG. 2 shows the amino acid sequence (SEQ ID NO:2) derived from the coding sequence of SEQ ID NO:1 shown in FIG. 1.

FIG. 3 shows a nucleotide sequence (SEQ ID NO:3) of a native sequence PRO178 cDNA, wherein SEQ ID NO:3 is a clone designated herein as "DNA23339-1130".

FIG. 4 shows the amino acid sequence (SEQ ID NO:4) derived from the coding sequence of SEQ ID NO:3 shown in FIG. 3.

FIG. 5 shows a nucleotide sequence (SEQ ID NO:5) of a native sequence PRO444 cDNA, wherein SEQ ID NO:5 is a clone designated herein as "DNA26846-1397".

FIG. 6 shows the amino acid sequence (SEQ ID NO:6) derived from the coding sequence of SEQ ID NO:5 shown in FIG. 5.

FIG. 7 shows a nucleotide sequence (SEQ ID NO:7) of a native sequence PRO195 cDNA, wherein SEQ ID NO:7 is a clone designated herein as "DNA26847-1395".

FIG. 8 shows the amino acid sequence (SEQ ID NO:8) derived from the coding sequence of SEQ ID NO:7 shown in FIG. 7.

FIG. 9 shows a nucleotide sequence (SEQ ID NO:9) of a native sequence PRO182 cDNA, wherein SEQ ID NO:9 is a clone designated herein as "DNA27865-1091".

FIG. 10 shows the amino acid sequence (SEQ ID NO:10) derived from the coding sequence of SEQ ID NO:9 shown in FIG. 9.

FIG. 11 shows a nucleotide sequence (SEQ ID NO:11) of a native sequence PRO205 cDNA, wherein SEQ ID NO:1 is a clone designated herein as "DNA30868-1156".

FIG. 12 shows the amino acid sequence (SEQ ID NO:12) derived from the coding sequence of SEQ ID NO:11 shown in FIG. 11.

FIG. 13 shows a nucleotide sequence (SEQ ID NO:13) of a native sequence PRO204 cDNA, wherein SEQ ID NO:13 is a clone designated herein as "DNA30871-1157".

FIG. 14 shows the amino acid sequence (SEQ ID NO:14) derived from the coding sequence of SEQ ID NO:13 shown in FIG. 13.

FIG. 15 shows a nucleotide sequence (SEQ ID NO:15) of a native sequence PRO1873 cDNA, wherein SEQ ID NO:15 is a clone designated herein as "DNA30880".

FIG. 16 shows the amino acid sequence (SEQ ID NO:16) derived from the coding sequence of SEQ ID NO:15 shown in FIG. 15.

FIG. 17 shows a nucleotide sequence (SEQ ID NO:17) of a native sequence PRO214 cDNA, wherein SEQ ID NO:17 is a clone designated herein as "DNA32286-1191".

FIG. 18 shows the amino acid sequence (SEQ ID NO:18) derived from the coding sequence of SEQ ID NO:17 shown in FIG. 17.

FIG. 19 shows a nucleotide sequence (SEQ ID NO:19) of a native sequence PRO221 cDNA, wherein SEQ ID NO:19 is a clone designated herein as "DNA33089-1132".

FIG. 20 shows the amino acid sequence (SEQ ID NO:20) derived from the coding sequence of SEQ ID NO:19 shown in FIG. 19.

FIG. 21 shows a nucleotide sequence (SEQ ID NO:21) of a native sequence PRO228 cDNA, wherein SEQ ID NO:21 is a clone designated herein as "DNA33092-1202".

FIG. 22 shows the amino acid sequence (SEQ ID NO:22) derived from the coding sequence of SEQ ID NO:21 shown in FIG. 21.

FIG. 23 shows a nucleotide sequence (SEQ ID NO:23) of a native sequence PRO229 cDNA, wherein SEQ ID NO:23 is a clone designated herein as "DNA33100-1159".

FIG. 24 shows the amino acid sequence (SEQ ID NO:24) derived from the coding sequence of SEQ ID NO:23 shown in FIG. 23.

FIG. 25 shows a nucleotide sequence (SEQ ID NO:25) of a native sequence PRO230 cDNA, wherein SEQ ID NO:25 is a clone designated herein as "DNA33223-1136".

FIG. 26 shows the amino acid sequence (SEQ ID NO:26) derived from the coding sequence of SEQ ID NO:25 shown in FIG. 25.

FIG. 27 shows a nucleotide sequence (SEQ ID NO:27) of a native sequence PRO7223 cDNA, wherein SEQ ID NO:27 is a clone designated herein as "DNA34385".

FIG. 28 shows the amino acid sequence (SEQ ID NO:28) derived from the coding sequence of SEQ ID NO:27 shown in FIG. 27.

FIG. 29 shows a nucleotide sequence (SEQ ID NO:29) of a native sequence PRO241 cDNA, wherein SEQ ID NO:29 is a clone designated herein as "DNA34392-1170".

FIG. 30 shows the amino acid sequence (SEQ ID NO:30) derived from the coding sequence of SEQ ID NO:29 shown in FIG. 29.

FIG. 31 shows a nucleotide sequence (SEQ ID NO:31) of a native sequence PRO263 cDNA, wherein SEQ ID NO:31 is a clone designated herein as "DNA34431-1177".

FIG. 32 shows the amino acid sequence (SEQ ID NO:32) derived from the coding sequence of SEQ ID NO:31 shown in FIG. 31.

FIG. 33 shows a nucleotide sequence (SEQ ID NO:33) of a native sequence PRO321 cDNA, wherein SEQ ID NO:33 is a clone designated herein as "DNA34433-1308".

FIG. 34 shows the amino acid sequence (SEQ ID NO:34) derived from the coding sequence of SEQ ID NO:33 shown in FIG. 33.

FIG. 35 shows a nucleotide sequence (SEQ ID NO:35) of a native sequence PRO231 cDNA, wherein SEQ ID NO:35 is a clone designated herein as "DNA34434-1139".

FIG. 36 shows the amino acid sequence (SEQ ID NO:36) derived from the coding sequence of SEQ ID NO:35 shown in FIG. 35.

FIG. 37 shows a nucleotide sequence (SEQ ID NO:37) of a native sequence PRO238 cDNA, wherein SEQ ID NO:37 is a clone designated herein as "DNA35600-1162".

FIG. 38 shows the amino acid sequence (SEQ ID NO:38) derived from the coding sequence of SEQ ID NO:37 shown in FIG. 37.

FIG. 39 shows a nucleotide sequence (SEQ ID NO:39) of a native sequence PRO247 cDNA, wherein SEQ ID NO:39 is a clone designated herein as "DNA35673-1201".

FIG. 40 shows the amino acid sequence (SEQ ID NO:40) derived from the coding sequence of SEQ ID NO:39 shown in FIG. 39.

FIG. 41 shows a nucleotide sequence (SEQ ID NO:41) of a native sequence PRO256 cDNA, wherein SEQ ID NO:41 is a clone designated herein as "DNA35880-1160".

FIG. 42 shows the amino acid sequence (SEQ ID NO:42) derived from the coding sequence of SEQ ID NO:41 shown in FIG. 41.

FIG. 43 shows a nucleotide sequence (SEQ ID NO:43) of a native sequence PRO258 cDNA, wherein SEQ ID NO:43 is a clone designated herein as "DNA35918-1174".

FIG. 44 shows the amino acid sequence (SEQ ID NO:44) derived from the coding sequence of SEQ ID NO:43 shown in FIG. 43.

FIG. 45 shows a nucleotide sequence (SEQ ID NO:45) of a native sequence PRO265 cDNA, wherein SEQ ID NO:45 is a clone designated herein as "DNA36350-1158".

FIG. 46 shows the amino acid sequence (SEQ ID NO:46) derived from the coding sequence of SEQ ID NO:45 shown in FIG. 45.

FIG. 47 shows a nucleotide sequence (SEQ ID NO:47) of a native sequence PRO21 cDNA, wherein SEQ ID NO:47 is a clone designated herein as "DNA36638-1056".

FIG. 48 shows the amino acid sequence (SEQ ID NO:48) derived from the coding sequence of SEQ ID NO:47 shown in FIG. 47.

FIG. 49 shows a nucleotide sequence (SEQ ID NO:49) of a native sequence PRO295 cDNA, wherein SEQ ID NO:49 is a clone designated herein as "DNA38268-1188".

FIG. 50 shows the amino acid sequence (SEQ ID NO:50) derived from the coding sequence of SEQ ID NO:49 shown in FIG. 49.

FIG. 51 shows a nucleotide sequence (SEQ ID NO:51) of a native sequence PRO302 cDNA, wherein SEQ ID NO:51 is a clone designated herein as "DNA40370-1217".

FIG. 52 shows the amino acid sequence (SEQ ID NO:52) derived from the coding sequence of SEQ ID NO:51 shown in FIG. 51.

FIG. 53 shows a nucleotide sequence (SEQ ID NO:53) of a native sequence PRO301 cDNA, wherein SEQ ID NO:53 is a clone designated herein as "DNA40628-1216".

FIG. 54 shows the amino acid sequence (SEQ ID NO:54) derived from the coding sequence of SEQ ID NO:53 shown in FIG. 53.

FIG. 55 shows a nucleotide sequence (SEQ ID NO:55) of a native sequence PRO337 cDNA, wherein SEQ ID NO:55 is a clone designated herein as "DNA43316-1237".

FIG. 56 shows the amino acid sequence (SEQ ID NO:56) derived from the coding sequence of SEQ ID NO:55 shown in FIG. 55.

FIG. 57 shows a nucleotide sequence (SEQ ID NO:57) of a native sequence PRO7248 cDNA, wherein SEQ ID NO:57 is a clone designated herein as "DNA44195".

FIG. 58 shows the amino acid sequence (SEQ ID NO:58) derived from the coding sequence of SEQ ID NO:57 shown in FIG. 57.

FIG. 59 shows a nucleotide sequence (SEQ ID NO:59) of a native sequence PRO846 cDNA, wherein SEQ ID NO:59 is a clone designated herein as "DNA44196-1353".

FIG. 60 shows the amino acid sequence (SEQ ID NO:60) derived from the coding sequence of SEQ ID NO:59 shown in FIG. 59.

FIG. 61 shows a nucleotide sequence (SEQ ID NO:61) of a native sequence PRO1864 cDNA, wherein SEQ ID NO:61 is a clone designated herein as "DNA45409-2511".

FIG. 62 shows the amino acid sequence (SEQ ID NO:62) derived from the coding sequence of SEQ ID NO:61 shown in FIG. 61.

FIG. 63 shows a nucleotide sequence (SEQ ID NO:63) of a native sequence PRO363 cDNA, wherein SEQ ID NO:63 is a clone designated herein as "DNA45419-1252".

FIG. 64 shows the amino acid sequence (SEQ ID NO:64) derived from the coding sequence of SEQ ID NO:63 shown in FIG. 63.

FIG. 65 shows a nucleotide sequence (SEQ ID NO:65) of a native sequence PRO730 cDNA, wherein SEQ ID NO:65 is a clone designated herein as "DNA45624-1400".

FIG. 66 shows the amino acid sequence (SEQ ID NO:66) derived from the coding sequence of SEQ ID NO:65 shown in FIG. 65.

FIG. 67 shows a nucleotide sequence (SEQ ID NO:67) of a native sequence PRO365 cDNA, wherein SEQ ID NO:67 is a clone designated herein as "DNA46777-1253".

FIG. 68 shows the amino acid sequence (SEQ ID NO:68) derived from the coding sequence of SEQ ID NO:67 shown in FIG. 67.

FIG. 69 shows a nucleotide sequence (SEQ ID NO:69) of a native sequence PRO532 cDNA, wherein SEQ ID NO:69 is a clone designated herein as "DNA48335".

FIG. 70 shows the amino acid sequence (SEQ ID NO:70) derived from the coding sequence of SEQ ID NO:69 shown in FIG. 69.

FIG. 71 shows a nucleotide sequence (SEQ ID NO:71) of a native sequence PRO322 cDNA, wherein SEQ ID NO:71 is a clone designated herein as "DNA48336-1309".

FIG. 72 shows the amino acid sequence (SEQ ID NO:72) derived from the coding sequence of SEQ ID NO:71 shown in FIG. 71.

FIG. 73 shows a nucleotide sequence (SEQ ID NO:73) of a native sequence PRO1120 cDNA, wherein SEQ ID NO:73 is a clone designated herein as "DNA48606-1479".

FIG. 74 shows the amino acid sequence (SEQ ID NO:74) derived from the coding sequence of SEQ ID NO:73 shown in FIG. 73.

FIG. 75 shows a nucleotide sequence (SEQ ID NO:75) of a native sequence PRO7261 cDNA, wherein SEQ ID NO:75 is a clone designated herein as "DNA49149".

FIG. 76 shows the amino acid sequence (SEQ ID NO:76) derived from the coding sequence of SEQ ID NO:75 shown in FIG. 75.

FIG. 77 shows a nucleotide sequence (SEQ ID NO:77) of a native sequence PRO533 cDNA, wherein SEQ ID NO:77 is a clone designated herein as "DNA49435-1219".

FIG. 78 shows the amino acid sequence (SEQ ID NO:78) derived from the coding sequence of SEQ ID NO:77 shown in FIG. 77.

FIG. 79 shows a nucleotide sequence (SEQ ID NO:79) of a native sequence PRO724 cDNA, wherein SEQ ID NO:79 is a clone designated herein as "DNA49631-1328".

FIG. 80 shows the amino acid sequence (SEQ ID NO:80) derived from the coding sequence of SEQ ID NO:79 shown in FIG. 79.

FIG. 81 shows a nucleotide sequence (SEQ ID NO:81) of a native sequence PRO734 cDNA, wherein SEQ ID NO:81 is a clone designated herein as "DNA49817".

FIG. 82 shows the amino acid sequence (SEQ ID NO:82) derived from the coding sequence of SEQ ID NO:81 shown in FIG. 81.

FIG. 83 shows a nucleotide sequence (SEQ ID NO:83) of a native sequence PRO771 cDNA, wherein SEQ ID NO:83 is a clone designated herein as "DNA49829-1346".

FIG. 84 shows the amino acid sequence (SEQ ID NO:84) derived from the coding sequence of SEQ ID NO:83 shown in FIG. 83.

FIG. 85 shows a nucleotide sequence (SEQ ID NO:85) of a native sequence PRO2010 cDNA, wherein SEQ ID NO:85 is a clone designated herein as "DNA50792".

FIG. 86 shows the amino acid sequence (SEQ ID NO:86) derived from the coding sequence of SEQ ID NO:85 shown in FIG. 85.

FIG. 87 shows a nucleotide sequence (SEQ ID NO:87) of a native sequence PRO871 cDNA, wherein SEQ ID NO:87 is a clone designated herein as "DNA50919-1361".

FIG. 88 shows the amino acid sequence (SEQ ID NO:88) derived from the coding sequence of SEQ ID NO:87 shown in FIG. 87.

FIG. 89 shows a nucleotide sequence (SEQ ID NO:89) of a native sequence PRO697 cDNA, wherein SEQ ID NO:89 is a clone designated herein as "DNA50920-1325".

FIG. 90 shows the amino acid sequence (SEQ ID NO:90) derived from the coding sequence of SEQ ID NO:89 shown in FIG. 89.

FIG. 91 shows a nucleotide sequence (SEQ ID NO:91) of a native sequence PRO1083 cDNA, wherein SEQ ID NO:91 is a clone designated herein as "DNA50921-1458".

FIG. 92 shows the amino acid sequence (SEQ ID NO:22) derived from the coding sequence of SEQ ID NO:91 shown in FIG. 91.

FIG. 93 shows a nucleotide sequence (SEQ ID NO:93) of a native sequence PRO725 cDNA, wherein SEQ ID NO:93 is a clone designated herein as "DNA52758-1399".

FIG. 94 shows the amino acid sequence (SEQ ID NO:94) derived from the coding sequence of SEQ ID NO:93 shown in FIG. 93.

FIG. 95 shows a nucleotide sequence (SEQ ID NO:95) of a native sequence PRO720 cDNA, wherein SEQ ID NO:95 is a clone designated herein as "DNA53517-1366-1".

FIG. 96 shows the amino acid sequence (SEQ ID NO:96) derived from the coding sequence of SEQ ID NO:95 shown in FIG. 95.

FIG. 97 shows a nucleotide sequence (SEQ ID NO:97) of a native sequence PRO738 cDNA, wherein SEQ ID NO:97 is a clone designated herein as "DNA53915-1258".

FIG. 98 shows the amino acid sequence (SEQ ID NO:98) derived from the coding sequence of SEQ ID NO:97 shown in FIG. 97.

FIG. 99 shows a nucleotide sequence (SEQ ID NO:99) of a native sequence PRO865 cDNA, wherein SEQ ID NO:99 is a clone designated herein as "DNA53974-1401".

FIG. 100 shows the amino acid sequence (SEQ ID NO:100) derived from the coding sequence of SEQ ID NO:99 shown in FIG. 99.

FIG. 101 shows a nucleotide sequence (SEQ ID NO:101) of a native sequence PRO840 cDNA, wherein SEQ ID NO:101 is a clone designated herein as "DNA53987-1438".

FIG. 102 shows the amino acid sequence (SEQ ID NO:102) derived from the coding sequence of SEQ ID NO:101 shown in FIG. 101.

FIG. 103 shows a nucleotide sequence (SEQ ID NO:103) of a native sequence PRO1080 cDNA, wherein SEQ ID NO:103 is a clone designated herein as "DNA56047-1456".

FIG. 104 shows the amino acid sequence (SEQ ID NO:104) derived from the coding sequence of SEQ ID NO:103 shown in FIG. 103.

FIG. 105 shows a nucleotide sequence (SEQ ID NO:105) of a native sequence PRO1079 cDNA, wherein SEQ ID NO:105 is a clone designated herein as "DNA56050-1455".

FIG. 106 shows the amino acid sequence (SEQ ID NO:106) derived from the coding sequence of SEQ ID NO:105 shown in FIG. 105.

FIG. 107 shows a nucleotide sequence (SEQ ID NO:107) of a native sequence PRO793 cDNA, wherein SEQ ID NO:107 is a clone designated herein as "DNA56110-1437".

FIG. 108 shows the amino acid sequence (SEQ ID NO:108) derived from the coding sequence of SEQ ID NO:107 shown in FIG. 107.

FIG. 109 shows a nucleotide sequence (SEQ ID NO:109) of a native sequence PRO788 cDNA, wherein SEQ ID NO:109 is a clone designated herein as "DNA56405-1357".

FIG. 110 shows the amino acid sequence (SEQ ID NO:110) derived from the coding sequence of SEQ ID NO:109 shown in FIG. 109.

FIG. 111 shows a nucleotide sequence (SEQ ID NO:111) of a native sequence PRO938 cDNA, wherein SEQ ID NO:111 is a clone designated herein as "DNA56433-1406".

FIG. 112 shows the amino acid sequence (SEQ ID NO:112) derived from the coding sequence of SEQ ID NO:111 shown in FIG. 111.

FIG. 113 shows a nucleotide sequence (SEQ ID NO:113) of a native sequence PRO1012 cDNA, wherein SEQ ID NO:113 is a clone designated herein as "DNA56439-1376".

FIG. 114 shows the amino acid sequence (SEQ ID NO:114) derived from the coding sequence of SEQ ID NO:113 shown in FIG. 113.

FIG. 115 shows a nucleotide sequence (SEQ ID NO:115) of a native sequence PRO1477 cDNA, wherein SEQ ID NO:115 is a clone designated herein as "DNA56529-1647".

FIG. 116 shows the amino acid sequence (SEQ ID NO:116) derived from the coding sequence of SEQ ID NO:115 shown in FIG. 115.

FIG. 117 shows a nucleotide sequence (SEQ ID NO:117) of a native sequence PRO1134 cDNA, wherein SEQ ID NO:117 is a clone designated herein as "DNA56865-1491".

FIG. 118 shows the amino acid sequence (SEQ ID NO:118) derived from the coding sequence of SEQ ID NO:117 shown in FIG. 117.

FIG. 119 shows a nucleotide sequence (SEQ ID NO:119) of a native sequence PRO162 cDNA, wherein SEQ ID NO:119 is a clone designated herein as "DNA56965-1356".

FIG. 120 shows the amino acid sequence (SEQ ID NO:120) derived from the coding sequence of SEQ ID NO:119 shown in FIG. 119.

FIG. 121 shows a nucleotide sequence (SEQ ID NO:121) of a native sequence PRO1114 cDNA, wherein SEQ ID NO:121 is a clone designated herein as "DNA57033-1403-1".

FIG. 122 shows the amino acid sequence (SEQ ID NO:122) derived from the coding sequence of SEQ ID NO:121 shown in FIG. 121.

FIG. 123 shows a nucleotide sequence (SEQ ID NO:123) of a native sequence PRO828 cDNA, wherein SEQ ID NO:123 is a clone designated herein as "DNA57037-1444".

FIG. 124 shows the amino acid sequence (SEQ ID NO:124) derived from the coding sequence of SEQ ID NO:123 shown in FIG. 123.

FIG. 125 shows a nucleotide sequence (SEQ ID NO 125) of a native sequence PRO827 cDNA, wherein SEQ ID NO:125 is a clone designated herein as "DNA57039-1402".

FIG. 126 shows the amino acid sequence (SEQ ID NO:126) derived from the coding sequence of SEQ ID NO:125 shown in FIG. 125.

FIG. 127 shows a nucleotide sequence (SEQ ID NO:127) of a native sequence PRO1075 cDNA, wherein SEQ ID NO:127 is a clone designated herein as "DNA57689-1385".

FIG. 128 shows the amino acid sequence (SEQ ID NO:128) derived from the coding sequence of SEQ ID NO:127 shown in FIG. 127.

FIG. 129 shows a nucleotide sequence (SEQ ID NO:129) of a native sequence PRO1007 cDNA, wherein SEQ ID NO:129 is a clone designated herein as "DNA57690-1374".

FIG. 130 shows the amino acid sequence (SEQ ID NO:130) derived from the coding sequence of SEQ ID NO:129 shown in FIG. 129.

FIG. 131 shows a nucleotide sequence (SEQ ID NO:131) of a native sequence PRO826 cDNA, wherein SEQ ID NO:131 is a clone designated herein as "DNA57694-1341".

FIG. 132 shows the amino acid sequence (SEQ ID NO:132) derived from the coding sequence of SEQ ID NO:131 shown in FIG. 131.

FIG. 133 shows a nucleotide sequence (SEQ ID NO:133) of a native sequence PRO819 cDNA, wherein SEQ ID NO:132 is a clone designated herein as "DNA57695-1340".

FIG. 134 shows the amino acid sequence (SEQ ID NO:134) derived from the coding sequence of SEQ ID NO:133 shown in FIG. 133.

FIG. 135 shows a nucleotide sequence (SEQ ID NO:135) of a native sequence PRO1006 cDNA, wherein SEQ ID NO:135 is a clone designated herein as "DNA57699-1412".

FIG. 136 shows the amino acid sequence (SEQ ID NO:136) derived from the coding sequence of SEQ ID NO:135 shown in FIG. 135.

FIG. 137 shows a nucleotide sequence (SEQ ID NO:137) of a native sequence PRO982 cDNA, wherein SEQ ID NO:137 is a clone designated herein as "DNA57700-1408".

FIG. 138 shows the amino acid sequence (SEQ ID NO:138) derived from the coding sequence of SEQ ID NO:137 shown in FIG. 137.

FIG. 139 shows a nucleotide sequence (SEQ ID NO:139) of a native sequence PRO1005 cDNA, wherein SEQ ID NO:139 is a clone designated herein as "DNA57708-1411".

FIG. 140 shows the amino acid sequence (SEQ ID NO:140) derived from the coding sequence of SEQ ID NO:139 shown in FIG. 139.

FIG. 141 shows a nucleotide sequence (SEQ ID NO:141) of a native sequence PRO791 cDNA, wherein SEQ ID NO:141 is a clone designated herein as "DNA57838-1337".

FIG. 142 shows the amino acid sequence (SEQ ID NO:142) derived from the coding sequence of SEQ ID NO:141 shown in FIG. 141.

FIG. 143 shows a nucleotide sequence (SEQ ID NO:143) of a native sequence PRO1071 cDNA, wherein SEQ ID NO:143 is a clone designated herein as "DNA58847-1383".

FIG. 144 shows the amino acid sequence (SEQ ID NO:144) derived from the coding sequence of SEQ ID NO:143 shown in FIG. 43.

FIG. 145 shows a nucleotide sequence (SEQ ID NO:145) of a native sequence PRO1415 cDNA, wherein SEQ ID NO:145 is a clone designated herein as "DNA58852-1637".

FIG. 146 shows the amino acid sequence (SEQ ID NO:146) derived from the coding sequence of SEQ ID NO:145 shown in FIG. 145.

FIG. 147 shows a nucleotide sequence (SEQ ID NO:147) of a native sequence PRO1054 cDNA, wherein SEQ ID NO:147 is a clone designated herein as "DNA58853-1423".

FIG. 148 shows the amino acid sequence (SEQ ID NO:148) derived from the coding sequence of SEQ ID NO:147 shown in FIG. 147.

FIG. 149 shows a nucleotide sequence (SEQ ID NO:149) of a native sequence PRO1411 cDNA, wherein SEQ ID NO:149 is a clone designated herein as "DNA59212-1627".

FIG. 150 shows the amino acid sequence (SEQ ID NO:150) derived from the coding sequence of SEQ ID NO:149 shown in FIG. 149.

FIG. 151 shows a nucleotide sequence (SEQ ID NO:151) of a native sequence PRO1184 cDNA, wherein SEQ ID NO:151 is a clone designated herein as "DNA59220-1514".

FIG. 152 shows the amino acid sequence (SEQ ID NO:152) derived from the coding sequence of SEQ ID NO:151 shown in FIG. 151.

FIG. 153 shows a nucleotide sequence (SEQ ID NO:153) of a native sequence PRO1029 cDNA, wherein SEQ ID NO:153 is a clone designated herein as "DNA59493-1420".

FIG. 154 shows the amino acid sequence (SEQ ID NO:154) derived from the coding sequence of SEQ ID NO:153 shown in FIG. 153.

FIG. 155 shows a nucleotide sequence (SEQ ID NO:155) of a native sequence PRO1139 cDNA, wherein SEQ ID NO:155 is a clone designated herein as "DNA59497-1496".

FIG. 156 shows the amino acid sequence (SEQ ID NO:156) derived from the coding sequence of SEQ ID NO:155 shown in FIG. 155.

FIG. 157 shows a nucleotide sequence (SEQ ID NO:157) of a native sequence PRO1190 cDNA, wherein SEQ ID NO:157 is a clone designated herein as "DNA59586-1520".

FIG. 158 shows the amino acid sequence (SEQ ID NO:158) derived from the coding sequence of SEQ ID NO:157 shown in FIG. 157.

FIG. 159 shows a nucleotide sequence (SEQ ID NO:159) of a native sequence PRO1309 cDNA, wherein SEQ ID NO:159 is a clone designated herein as "DNA59588-1571".

FIG. 160 shows the amino acid sequence (SEQ ID NO:160) derived from the coding sequence of SEQ ID NO:159 shown in FIG. 159.

FIG. 161 shows a nucleotide sequence (SEQ ID NO:161) of a native sequence PRO836 cDNA, wherein SEQ ID NO:161 is a clone designated herein as "DNA59620-1463".

FIG. 162 shows the amino acid sequence (SEQ ID NO:162) derived from the coding sequence of SEQ ID NO:161 shown in FIG. 161.

FIG. 163 shows a nucleotide sequence (SEQ ID NO:163) of a native sequence PRO1025 cDNA, wherein SEQ ID NO:163 is a clone designated herein as "DNA59622-1334".

FIG. 164 shows the amino acid sequence (SEQ ID NO:164) derived from the coding sequence of SEQ ID NO:163 shown in FIG. 163.

FIG. 165 shows a nucleotide sequence (SEQ ID NO:165) of a native sequence PRO1131 cDNA, wherein SEQ ID NO:165 is a clone designated herein as "DNA59777-1480".

FIG. 166 shows the amino acid sequence (SEQ ID NO:166) derived from the coding sequence of SEQ ID NO:165 shown in FIG. 165.

FIG. 167 shows a nucleotide sequence (SEQ ID NO:167) of a native sequence PRO1182 cDNA, wherein SEQ ID NO:167 is a clone designated herein as "DNA59848-1512".

FIG. 168 shows the amino acid sequence (SEQ ID NO:168) derived from the coding sequence of SEQ ID NO:167 shown in FIG. 167.

FIG. 169 shows a nucleotide sequence (SEQ ID NO:169) of a native sequence PRO1155 cDNA, wherein SEQ ID NO:169 is a clone designated herein as "DNA59849-1504".

FIG. 170 shows the amino acid sequence (SEQ ID NO:170) derived from the coding sequence of SEQ ID NO:169 shown in FIG. 169.

FIG. 171 shows a nucleotide sequence (SEQ ID NO:171) of a native sequence PRO1186 cDNA, wherein SEQ ID NO:171 is a clone designated herein as "DNA60621-1516".

FIG. 172 shows the amino acid sequence (SEQ ID NO:172) derived from the coding sequence of SEQ ID NO:171 shown in FIG. 171.

FIG. 173 shows a nucleotide sequence (SEQ ID NO:173) of a native sequence PRO1198 cDNA, wherein SEQ ID NO:173 is a clone designated herein as "DNA60622-1525".

FIG. 174 shows the amino acid sequence (SEQ ID NO:174) derived from the coding sequence of SEQ ID NO:173 shown in FIG. 173.

FIG. 175 shows a nucleotide sequence (SEQ ID NO:175) of a native sequence PRO1265 cDNA, wherein SEQ ID NO:175 is a clone designated herein as "DNA60764-1533".

FIG. 176 shows the amino acid sequence (SEQ ID NO:176) derived from the coding sequence of SEQ ID NO:175 shown in FIG. 175.

FIG. 177 shows a nucleotide sequence (SEQ ID NO:177) of a native sequence PRO361 cDNA, wherein SEQ ID NO:177 is a clone designated herein as "DNA60783-1611".

FIG. 178 shows the amino acid sequence (SEQ ID NO:178) derived from the coding sequence of SEQ ID NO:177 shown in FIG. 177.

FIG. 179 shows a nucleotide sequence (SEQ ID NO:179) of a native sequence PRO1287 cDNA, wherein SEQ ID NO:179 is a clone designated herein as "DNA61755-1554".

FIG. 180 shows the amino acid sequence (SEQ ID NO:180) derived from the coding sequence of SEQ ID NO:179 shown in FIG. 179.

FIG. 181 shows a nucleotide sequence (SEQ ID NO:181) of a native sequence PRO1308 cDNA, wherein SEQ ID NO:181 is a clone designated herein as "DNA62306-1570".

FIG. 182 shows the amino acid sequence (SEQ ID NO:182) derived from the coding sequence of SEQ ID NO:181 shown in FIG. 181.

FIG. 183 shows a nucleotide sequence (SEQ ID NO:183) of a native sequence PRO4313 cDNA, wherein SEQ ID NO:183 is a clone designated herein as "DNA62312-2558".

FIG. 184 shows the amino acid sequence (SEQ ID NO:184) derived from the coding sequence of SEQ ID NO:183 shown in FIG. 183.

FIG. 185 shows a nucleotide sequence (SEQ ID NO:185) of a native sequence PRO1192 cDNA, wherein SEQ ID NO:185 is a clone designated herein as "DNA62814-1521".

FIG. 186 shows the amino acid sequence (SEQ ID NO:186) derived from the coding sequence of SEQ ID NO:185 shown in FIG. 185.

FIG. 187 shows a nucleotide sequence (SEQ ID NO:187) of a native sequence PRO1160 cDNA, wherein SEQ ID NO:187 is a clone designated herein as "DNA62872-1509".

FIG. 188 shows the amino acid sequence (SEQ ID NO:188) derived from the coding sequence of SEQ ID NO:187 shown in FIG. 187.

FIG. 189 shows a nucleotide sequence (SEQ ID NO:189) of a native sequence PRO1244 cDNA, wherein SEQ ID NO:189 is a clone designated herein as "DNA64883-1526".

FIG. 190 shows the amino acid sequence (SEQ ID NO:190) derived from the coding sequence of SEQ ID NO:189 shown in FIG. 189.

FIG. 191 shows a nucleotide sequence (SEQ ID NO:191) of a native sequence PRO1356 cDNA, wherein SEQ ID NO:191 is a clone designated herein as "DNA64886-1601".

FIG. 192 shows the amino acid sequence (SEQ ID NO:192) derived from the coding sequence of SEQ ID NO:191 shown in FIG. 191.

FIG. 193 shows a nucleotide sequence (SEQ ID NO:193) of a native sequence PRO1274 cDNA, wherein SEQ ID NO:193 is a clone designated herein as "DNA64889-1541".

FIG. 194 shows the amino acid sequence (SEQ ID NO:194) derived from the coding sequence of SEQ ID NO:193 shown in FIG. 193.

FIG. 195 shows a nucleotide sequence (SEQ ID NO:195) of a native sequence PRO1272 cDNA, wherein SEQ ID NO:195 is a clone designated herein as "DNA64896-1539".

FIG. 196 shows the amino acid sequence (SEQ ID NO:196) derived from the coding sequence of SEQ ID NO:195 shown in FIG. 195.

FIG. 197 shows a nucleotide sequence (SEQ ID NO:197) of a native sequence PRO1412 cDNA, wherein SEQ ID NO:197 is a clone designated herein as "DNA64897-1628".

FIG. 198 shows the amino acid sequence (SEQ ID NO:198) derived from the coding sequence of SEQ ID NO:197 shown in FIG. 197.

FIG. 199 shows a nucleotide sequence (SEQ ID NO:199) of a native sequence PRO1286 cDNA, wherein SEQ ID NO:199 is a clone designated herein as "DNA64903-1553".

FIG. 200 shows the amino acid sequence (SEQ ID NO:200) derived from the coding sequence of SEQ ID NO:199 shown in FIG. 199.

FIG. 201 shows a nucleotide sequence (SEQ ID NO:201) of a native sequence PRO1347 cDNA, wherein SEQ ID NO:201 is a clone designated herein as "DNA64950-1590".

FIG. 202 shows the amino acid sequence (SEQ ID NO:202) derived from the coding sequence of SEQ ID NO:201 shown in FIG. 201.

FIG. 203 shows a nucleotide sequence (SEQ ID NO:203) of a native sequence PRO1273 cDNA, wherein SEQ ID NO:203 is a clone designated herein as "DNA65402-1540".

FIG. 204 shows the amino acid sequence (SEQ ID NO:204) derived from the coding sequence of SEQ ID NO:203 shown in FIG. 203.

FIG. 205 shows a nucleotide sequence (SEQ ID NO:205) of a native sequence PRO1283 cDNA, wherein SEQ ID NO:205 is a clone designated herein as "DNA65404-1551".

FIG. 206 shows the amino acid sequence (SEQ ID NO:206) derived from the coding sequence of SEQ ID NO:205 shown in FIG. 205.

FIG. 207 shows a nucleotide sequence (SEQ ID NO:207) of a native sequence PRO1279 cDNA, wherein SEQ ID NO:207 is a clone designated herein as "DNA65405-1547".

FIG. 208 shows the amino acid sequence (SEQ ID NO:208) derived from the coding sequence of SEQ ID NO:207 shown in FIG. 207.

FIG. 209 shows a nucleotide sequence (SEQ ID NO:209) of a native sequence PRO1306 cDNA, wherein SEQ ID NO:209 is a clone designated herein as "DNA65410-1569".

FIG. 210 shows the amino acid sequence (SEQ ID NO:210) derived from the coding sequence of SEQ ID NO:209 shown in FIG. 209.

FIG. 211 shows a nucleotide sequence (SEQ ID NO:211) of a native sequence PRO1195 cDNA, wherein SEQ ID NO:211 is a clone designated herein as "DNA65412-1523".

FIG. 212 shows the amino acid sequence (SEQ ID NO:212) derived from the coding sequence of SEQ ID NO:211 shown in FIG. 211.

FIG. 213 shows a nucleotide sequence (SEQ ID NO:213) of a native sequence PRO4995 cDNA, wherein SEQ ID NO:213 is a clone designated herein as "DNA66307-2661".

FIG. 214 shows the amino acid sequence (SEQ ID NO:214) derived from the coding sequence of SEQ ID NO:213 shown in FIG. 213.

FIG. 215 shows a nucleotide sequence (SEQ ID NO:215) of a native sequence PRO1382 cDNA, wherein SEQ ID NO:215 is a clone designated herein as "DNA66526-1616".

FIG. 216 shows the amino acid sequence (SEQ ID NO:216) derived from the coding sequence of SEQ ID NO:215 shown in FIG. 215.

FIG. 217 shows a nucleotide sequence (SEQ ID NO:217) of a native sequence PRO1325 cDNA, wherein SEQ ID NO:217 is a clone designated herein as "DNA66659-1593".

FIG. 218 shows the amino acid sequence (SEQ ID NO:218) derived from the coding sequence of SEQ ID NO:217 shown in FIG. 217.

FIG. 219 shows a nucleotide sequence (SEQ ID NO:219) of a native sequence PRO1329 cDNA, wherein SEQ ID NO:219 is a clone designated herein as "DNA66660-1585".

FIG. 220 shows the amino acid sequence (SEQ ID NO:220) derived from the coding sequence of SEQ ID NO:219 shown in FIG. 219.

FIG. 221 shows a nucleotide sequence (SEQ ID NO:221) of a native sequence PRO1338 cDNA, wherein SEQ ID NO:221 is a clone designated herein as "DNA66667-1596".

FIG. 222 shows the amino acid sequence (SEQ ID NO:222) derived from the coding sequence of SEQ ID NO:221 shown in FIG. 221.

FIG. 223 shows a nucleotide sequence(SEQ ID NO:223) of a native sequence PRO1337 cDNA, wherein SEQ ID NO:223 is a clone designated herein as "DNA66672-1586".

FIG. 224 shows the amino acid sequence (SEQ ID NO:224) derived from the coding sequence of SEQ ID NO:223 shown in FIG. 223.

FIG. 225 shows a nucleotide sequence (SEQ ID NO:225) of a native sequence PRO1343 cDNA, wherein SEQ ID NO:225 is a clone designated herein as "DNA66675-1587".

FIG. 226 shows the amino acid sequence (SEQ ID NO:226) derived from the coding sequence of SEQ ID NO:225 shown in FIG. 225.

FIG. 227 shows a nucleotide sequence (SEQ ID NO:227) of a native sequence PRO1376 cDNA, wherein SEQ ID NO:227 is a clone designated herein as "DNA67300-1605".

FIG. 228 shows the amino acid sequence (SEQ ID NO:228) derived from the coding sequence of SEQ ID NO:227 shown in FIG. 227.

FIG. 229 shows a nucleotide sequence (SEQ ID NO:229) of a native sequence PRO1434 cDNA, wherein SEQ ID NO:229 is a clone designated herein as "DNA68818-2536".

FIG. 230 shows the amino acid sequence (SEQ ID NO:230) derived from the coding sequence of SEQ ID NO:229 shown in FIG. 229.

FIG. 231 shows a nucleotide sequence (SEQ ID NO:231) of a native sequence PRO3579 cDNA, wherein SEQ ID NO:231 is a clone designated herein as "DNA68862-2546".

FIG. 232 shows the amino acid sequence (SEQ ID NO:232) derived from the coding sequence of SEQ ID NO:231 shown in FIG. 231.

FIG. 233 shows a nucleotide sequence (SEQ ID NO:233) of a native sequence PRO1387 cDNA, wherein SEQ ID NO:233 is a clone designated herein as "DNA68872-1620".

FIG. 234 shows the amino acid sequence (SEQ ID NO:234) derived from the coding sequence of SEQ ID NO:233 shown in FIG. 233.

FIG. 235 shows a nucleotide sequence (SEQ ID NO:235) of a native sequence PRO1419 cDNA, wherein SEQ ID NO:235 is a clone designated herein as "DNA71290-1630".

FIG. 236 shows the amino acid sequence (SEQ ID NO:236) derived from the coding sequence of SEQ ID NO:235 shown in FIG. 235.

FIG. 237 shows a nucleotide sequence (SEQ ID NO:237) of a native sequence PRO1488 cDNA, wherein SEQ ID NO:237 is a clone designated herein as "DNA73736-1657".

FIG. 238 shows the amino acid sequence (SEQ ID NO:238) derived from the coding sequence of SEQ ID NO:237 shown in FIG. 237.

FIG. 239 shows a nucleotide sequence (SEQ ID NO:239) of a native sequence PRO1474 cDNA, wherein SEQ ID NO:239 is a clone designated herein as "DNA73739-1645".

FIG. 240 shows the amino acid sequence (SEQ ID NO:240) derived from the coding sequence of SEQ ID NO:239 shown in FIG. 239.

FIG. 241 shows a nucleotide sequence (SEQ ID NO:241) of a native sequence PRO1508 cDNA, wherein SEQ ID NO:241 is a clone designated herein as "DNA73742-1662".

FIG. 242 shows the amino acid sequence (SEQ ID NO:242) derived from the coding sequence of SEQ ID NO:241 shown in FIG. 241.

FIG. 243 shows a nucleotide sequence (SEQ ID NO:243) of a native sequence PRO1754 cDNA, wherein SEQ ID NO:243 is a clone designated herein as "DNA76385-1692".

FIG. 244 shows the amino acid sequence (SEQ ID NO:244) derived from the coding sequence of SEQ ID NO:243 shown in FIG. 243.

FIG. 245 shows a nucleotide sequence (SEQ ID NO:245) of a native sequence PRO1550 cDNA, wherein SEQ ID NO:245 is a clone designated herein as "DNA76393-1664".

FIG. 246 shows the amino acid sequence (SEQ ID NO:246) derived from the coding sequence of SEQ ID NO:245 shown in FIG. 245.

FIG. 247 shows a nucleotide sequence (SEQ ID NO:247) of a native sequence PRO1758 cDNA, wherein SEQ ID NO:247 is a clone designated herein as "DNA76399-1700".

FIG. 248 shows the amino acid sequence (SEQ ID NO:248) derived from the coding sequence of SEQ ID NO:247 shown in FIG. 247.

FIG. 249 shows a nucleotide sequence (SEQ ID NO:249) of a native sequence PRO1917 cDNA, wherein SEQ ID NO:249 is a clone designated herein as "DNA76400-2528".

FIG. 250 shows the amino acid sequence (SEQ ID NO:250) derived from the coding sequence of SEQ ID NO:249 shown in FIG. 249.

FIG. 251 shows a nucleotide sequence (SEQ ID NO:251) of a native sequence PRO1787 cDNA, wherein SEQ ID NO:251 is a clone designated herein as "DNA76510-2504".

FIG. 252 shows the amino acid sequence (SEQ ID NO:252) derived from the coding sequence of SEQ ID NO:251 shown in FIG. 251.

FIG. 253 shows a nucleotide sequence (SEQ ID NO:253) of a native sequence PRO1556 cDNA, wherein SEQ ID NO:253 is a clone designated herein as "DNA76529-1666".

FIG. 254 shows the amino acid sequence (SEQ ID NO:254) derived from the coding sequence of SEQ ID NO:253 shown in FIG. 253.

FIG. 255 shows a nucleotide sequence (SEQ ID NO:255) of anative sequence PRO1760 cDNA, wherein SEQ ID NO:255 is a clone designated herein as "DNA76532-1702".

FIG. 256 shows the amino acid sequence (SEQ ID NO:256) derived from the coding sequence of SEQ ID NO:255 shown in FIG. 255.

FIG. 257 shows a nucleotide sequence (SEQ ID NO:257) of a native sequence PRO1567 cDNA, wherein SEQ ID NO:257 is a clone designated herein as "DNA76541-1675".

FIG. 258 shows the amino acid sequence (SEQ ID NO:258) derived from the coding sequence of SEQ ID NO:257 shown in FIG. 257.

FIG. 259 shows a nucleotide sequence (SEQ ID NO:259) of a native sequence PRO1600 cDNA, wherein SEQ ID NO:259 is a clone designated herein as "DNA77503-1686".

FIG. 260 shows the amino acid sequence (SEQ ID NO:260) derived from the coding sequence of SEQ ID NO:259 shown in FIG. 259.

FIG. 261 shows a nucleotide sequence (SEQ ID NO:261) of a native sequence PRO1868 cDNA, wherein SEQ ID NO:261 is a clone designated herein as "DNA77624-2515".

FIG. 262 shows the amino acid sequence (SEQ ID NO:262) derived from the coding sequence of SEQ ID NO:261 shown in FIG. 261.

FIG. 263 shows a nucleotide sequence (SEQ ID NO:263) of a native sequence PRO1890 cDNA, wherein SEQ ID NO:263 is a clone designated herein as "DNA79230-2525".

FIG. 264 shows the amino acid sequence (SEQ ID NO:264) derived from the coding sequence of SEQ ID NO:263 shown in FIG. 263.

FIG. 265 shows a nucleotide sequence (SEQ ID NO:265) of a native sequence PRO1887 cDNA, wherein SEQ ID NO:265 is a clone designated herein as "DNA79862-2522".

FIG. 266 shows the amino acid sequence (SEQ ID NO:265) derived from the coding sequence of SEQ ID NO:265 shown in FIG. 265.

FIG. 267 shows a nucleotide sequence (SEQ ID NO:267) of a native sequence PRO4353 cDNA, wherein SEQ ID NO:267 is a clone designated herein as "DNA80145-2594".

FIG. 268 shows the amino acid sequence (SEQ ID NO:268) derived from the coding sequence of SEQ ID NO:267 shown in FIG. 267.

FIG. 269 shows a nucleotide sequence (SEQ ID NO:269) of a native sequence PRO1782 cDNA, wherein SEQ ID NO:269 is a clone designated herein as "DNA80899-2501".

FIG. 270 shows the amino acid sequence (SEQ ID NO:270) derived from the coding sequence of SEQ ID NO:269 shown in FIG. 269.

FIG. 271 shows a nucleotide sequence (SEQ ID NO:271) of a native sequence PRO1928 cDNA, wherein SEQ ID NO:271 is a clone designated herein as "DNA81754-2532".

FIG. 272 shows the amino acid sequence (SEQ ID NO:272) derived from the coding sequence of SEQ ID NO:271 shown in FIG. 271.

FIG. 273 shows a nucleotide sequence (SEQ ID NO:273) of a native sequence PRO1865 cDNA, wherein SEQ ID NO:273 is a clone designated herein as "DNA81757-2512".

FIG. 274 shows the amino acid sequence (SEQ ID NO:274) derived from the coding sequence of SEQ ID NO:273 shown in FIG. 273.

FIG. 275 shows a nucleotide sequence (SEQ ID NO:275) of a native sequence PRO4341 cDNA, wherein SEQ ID NO:275 is a clone designated herein as "DNA81761-2583".

FIG. 276 shows the amino acid sequence (SEQ ID NO:276) derived from the coding sequence of SEQ ID NO:275 shown in FIG. 275.

FIG. 277 shows a nucleotide sequence (SEQ ID NO:277) of a native sequence PRO6714 cDNA, wherein SEQ ID NO:277 is a clone designated herein as "DNA82358-2738".

FIG. 278 shows the amino acid sequence (SEQ ID NO:278) derived from the coding sequence of SEQ ID NO:277 shown in FIG. 277.

FIG. 279 shows a nucleotide sequence (SEQ ID NO:279) of a native sequence PRO5723 cDNA, wherein SEQ ID NO:279 is a clone designated herein as "DNA82361".

FIG. 280 shows the amino acid sequence (SEQ ID NO:280) derived from the coding sequence of SEQ ID NO:279 shown in FIG. 279.

FIG. 281 shows a nucleotide sequence (SEQ ID NO:281) of a native sequence PRO3438 cDNA, wherein SEQ ID NO:281 is a clone designated herein as "DNA82364-2538".

FIG. 282 shows the amino acid sequence (SEQ ID NO:282) derived from the coding sequence of SEQ ID NO:281 shown in FIG. 281.

FIG. 283 shows a nucleotide sequence (SEQ ID NO:283) of a native sequence PRO6071 cDNA, wherein SEQ ID NO:283 is a clone designated herein as "DNA82403-2959".

FIG. 284 shows the amino acid sequence (SEQ ID NO:284) derived from the coding sequence of SEQ ID NO:283 shown in FIG. 283.

FIG. 285 shows a nucleotide sequence (SEQ ID NO:285) of a native sequence PRO1801 cDNA, wherein SEQ ID NO:285 is a clone designated herein as "DNA83500-2506".

FIG. 286 shows the amino acid sequence (SEQ ID NO:286) derived from the coding sequence of SEQ ID NO:285 shown in FIG. 285.

FIG. 287 shows a nucleotide sequence (SEQ ID NO:287) of a native sequence PRO4324 cDNA, wherein SEQ ID NO:287 is a clone designated herein as "DNA83560-2569".

FIG. 288 shows the amino acid sequence (SEQ ID NO:288) derived from the coding sequence of SEQ ID NO:287 shown in FIG. 287.

FIG. 289 shows a nucleotide sequence (SEQ IDNO:289) of a native sequence PRO4333 cDNA, wherein SEQ ID NO:289 is a clone designated herein as "DNA84210-2576".

FIG. 290 shows the amino acid sequence (SEQ ID NO:290) derived from the coding sequence of SEQ ID NO:289 shown in FIG. 289.

FIG. 291 shows a nucleotide sequence (SEQ ID NO:291) of a native sequence PRO4405 cDNA, wherein SEQ ID NO:291 is a clone designated herein as "DNA84920-2614".

FIG. 292 shows the amino acid sequence (SEQ ID NO:292) derived from the coding sequence of SEQ ID NO:291 shown in FIG. 291.

FIG. 293 shows a nucleotide sequence (SEQ ID NO:293) of a native sequence PRO4356 cDNA, wherein SEQ ID NO:293 is a clone designated herein as "DNA86576-2595".

FIG. 294 shows the amino acid sequence (SEQ ID NO:294) derived from the coding sequence of SEQ ID NO:293 shown in FIG. 293.

FIG. 295 shows a nucleotide sequence (SEQ ID NO:295) of a native sequence PRO3444 cDNA, wherein SEQ ID NO:295 is a clone designated herein as "DNA87997".

FIG. 296 shows the amino acid sequence (SEQ ID NO:296) derived from the coding sequence of SEQ ID NO:295 shown in FIG. 295.

FIG. 297 shows a nucleotide sequence (SEQ ID NO:297) of a native sequence PRO4302 cDNA, wherein SEQ ID NO:297 is a clone designated herein as "DNA92218-2554".

FIG. 298 shows the amino acid sequence (SEQ ID NO:298) derived from the coding sequence of SEQ ID NO:297 shown in FIG. 297.

FIG. 299 shows a nucleotide sequence (SEQ ID NO:299) of a native sequence PRO4371 cDNA, wherein SEQ ID NO:299 is a clone designated herein as "DNA92233-2599".

FIG. 300 shows the amino acid sequence (SEQ ID NO:300) derived from the coding sequence of SEQ ID NO:299 shown in FIG. 299.

FIG. 301 shows a nucleotide sequence (SEQ ID NO:301) of a native sequence PRO4354 cDNA, wherein SEQ ID NO:301 is a clone designated herein as "DNA92256-2596".

FIG. 302 shows the amino acid sequence (SEQ ID NO:302) derived from the coding sequence of SEQ ID NO:301 shown in FIG. 301.

FIG. 303 shows a nucleotide sequence (SEQ ID NO:303) of a native sequence PRO5725 cDNA, wherein SEQ ID NO:303 is a clone designated herein as "DNA92265-2669".

FIG. 304 shows the amino acid sequence (SEQ ID NO:304) derived from the coding sequence of SEQ ID NO:303 shown in FIG. 303.

FIG. 305 shows a nucleotide sequence (SEQ ID NO:305) of a native sequence PRO4408 cDNA, wherein SEQ ID NO:305 is a clone designated herein as "DNA92274-2617".

FIG. 306 shows the amino acid sequence (SEQ ID NO:306) derived from the coding sequence of SEQ ID NO:305 shown in FIG. 305.

FIG. 307 shows a nucleotide sequence (SEQ ID NO:307) of a native sequence PRO9940 cDNA, wherein SEQ ID NO:307 is a clone designated herein as "DNA92282".

FIG. 308 shows the amino acid sequence (SEQ ID NO:308) derived from the coding sequence of SEQ ID NO:307 shown in FIG. 307.

FIG. 309 shows a nucleotide sequence (SEQ ID NO:309) of a native sequence PRO5737 cDNA, wherein SEQ ID NO:309 is a clone designated herein as "DNA92929-2534-1".

FIG. 310 shows the amino acid sequence (SEQ ID NO:310) derived from the coding sequence of SEQ ID NO:309 shown in FIG. 309.

FIG. 311 shows a nucleotide sequence (SEQ ID NO:311) of a native sequence PRO4425 cDNA, wherein SEQ ID NO:311 is a clone designated herein as "DNA93011-2637".

FIG. 312 shows the amino acid sequence (SEQ ID NO:312) derived from the coding sequence of SEQ ID NO:311 shown in FIG. 311.

FIG. 313 shows a nucleotide sequence (SEQ ID NO:313) of a native sequence PRO4345 cDNA, wherein SEQ ID NO:313 is a clone designated herein as "DNA94854-2586".

FIG. 314 shows the amino acid sequence (SEQ ID NO:314) derived from the coding sequence of SEQ ID NO:313 shown in FIG. 313.

FIG. 315 shows a nucleotide sequence (SEQ ID NO:315) of a native sequence PRO4342 cDNA, wherein SEQ ID NO:315 is a clone designated herein as "DNA96787-2534-1".

FIG. 316 shows the amino acid sequence (SEQ ID NO:316) derived from the coding sequence of SEQ ID NO:315 shown in FIG. 315.

FIG. 317 shows a nucleotide sequence (SEQ ID NO:317) of a native sequence PRO3562 cDNA, wherein SEQ ID NO:317 is a clone designated herein as "DNA96791".

FIG. 318 shows the amino acid sequence (SEQ ID NO:318) derived from the coding sequence of SEQ ID NO:317 shown in FIG. 317.

FIG. 319 shows a nucleotide sequence (SEQ ID NO:319) of a native sequence PRO4422 cDNA, wherein SEQ ID NO:319 is a clone designated herein as "DNA96867-2620".

FIG. 320 shows the amino acid sequence (SEQ ID NO:320) derived from the coding sequence of SEQ ID NO:319 shown in FIG. 319.

FIG. 321 shows a nucleotide sequence (SEQ ID NO:321) of a native sequencePRO5776 cDNA, wherein SEQ ID NO:321 is a clone designated herein as "DNA96872-2674".

FIG. 322 shows the amino acid sequence (SEQ ID NO:322) derived from the coding sequence of SEQ ID NO:321 shown in FIG. 321.

FIG. 323 shows a nucleotide sequence (SEQ ID NO:323) of a native sequence PRO4430 cDNA, wherein SEQ ID NO:323 is a clone designated herein as "DNA96878-2626".

FIG. 324 shows the amino acid sequence (SEQ ID NO:324) derived from the coding sequence of SEQ ID NO:323 shown in FIG. 323.

FIG. 325 shows a nucleotide sequence (SEQ ID NO:325) of a native sequence PRO4499 cDNA, wherein SEQ ID NO:325 is a clone designated herein as "DNA96889-2641".

FIG. 326 shows the amino acid sequence (SEQ ID NO:326) derived from the coding sequence of SEQ ID NO:325 shown in FIG. 325.

FIG. 327 shows a nucleotide sequence (SEQ ID NO:327) of a native sequence PRO4503 cDNA, wherein SEQ ID NO:327 is a clone designated herein as "DNA100312-2645".

FIG. 328 shows the amino acid sequence (SEQ ID NO:328) derived from the coding sequence of SEQ ID NO:327 shown in FIG. 327.

FIG. 329 shows a nucleotide sequence (SEQ ID NO:329) of a native sequence PRO10008 cDNA, wherein SEQ ID NO:329 is a clone designated herein as "DNA101921".

FIG. 330 shows the amino acid sequence (SEQ ID NO:330) derived from the coding sequence of SEQ ID NO:329 shown in FIG. 329.

FIG. 331 shows a nucleotide sequence (SEQ ID NO:331) of a native sequence PRO5730 cDNA, wherein SEQ ID NO:331 is a clone designated herein as "DNA101926".

FIG. 332 shows the amino acid sequence (SEQ ID NO:332) derived from the coding sequence of SEQ ID NO:331 shown in FIG. 331.

FIG. 333 shows a nucleotide sequence (SEQ ID NO:333) of a native sequence PRO6008 cDNA, wherein SEQ ID NO:333 is a clone designated herein as "DNA102844".

FIG. 334 shows the amino acid sequence (SEQ ID NO:334) derived from the coding sequence of SEQ ID NO:333 shown in FIG. 333.

FIG. 335 shows a nucleotide sequence (SEQ ID NO:335) of a native sequence PRO4527 cDNA, wherein SEQ ID NO:335 is a clone designated herein as "DNA103197".

FIG. 336 shows the amino acid sequence (SEQ ID NO:336) derived from the coding sequence of SEQ ID NO:335 shown in FIG. 335.

FIG. 337 shows a nucleotide sequence (SEQ ID NO:337) of a native sequence PRO4538 cDNA, wherein SEQ ID NO:337 is a clone designated herein as "DNA103208".

FIG. 338 shows the amino acid sequence (SEQ ID NO:338) derived from the coding sequence of SEQ ID NO:337 shown in FIG. 337.

FIG. 339 shows a nucleotide sequence (SEQ ID NO:339) of a native sequence PRO4553 cDNA, wherein SEQ ID NO:339 is a clone designated herein as "DNA103223".

FIG. 340 shows the amino acid sequence (SEQ ID NO:340) derived from the coding sequence of SEQ ID NO:339 shown in FIG. 339.

FIG. 341 shows a nucleotide sequence (SEQ ID NO:341) of a native sequence PRO6006 cDNA, wherein SEQ ID NO:341 is a clone designated herein as "DNA105782-2693".

FIG. 342 shows the amino acid sequence (SEQ ID NO:342) derived from the coding sequence of SEQ ID NO:341 shown in FIG. 341.

FIG. 343 shows a nucleotide sequence (SEQ ID NO:343) of a native sequence PRO6029 cDNA, wherein SEQ ID NO:343 is a clone designated herein as "DNA105849-2704".

FIG. 344 shows the amino acid sequence (SEQ ID NO:344) derived from the coding sequence of SEQ ID NO:343 shown in FIG. 343.

FIG. 345 shows a nucleotide sequence (SEQ ID NO:345) of a native sequence PRO9821 cDNA, wherein SEQ ID NO:345 is a clone designated herein as "DNA108725-2766".

FIG. 346 shows the amino acid sequence (SEQ ID NO:346) derived from the coding sequence of SEQ ID NO:345 shown in FIG. 345.

FIG. 347 shows a nucleotide sequence (SEQ ID NO:347) of a native sequence PRO9820 cDNA, wherein SEQ ID NO:347 is a clone designated herein as "DNA108769-2765".

FIG. 348 shows the amino acid sequence (SEQ ID NO:348) derived from the coding sequence of SEQ ID NO:347 shown in FIG. 347.

FIG. 349 shows a nucleotide sequence (SEQ ID NO:349) of a native sequence PRO9771 cDNA, wherein SEQ ID NO:349 is a clone designated herein as "DNA119498-2965".

FIG. 350 shows the amino acid sequence (SEQ ID NO:350) derived from the coding sequence of SEQ ID NO:349 shown in FIG. 349.

FIG. 351 shows a nucleotide sequence (SEQ ID NO:351) of a native sequence PRO7436 cDNA, wherein SEQ ID NO:351 is a clone designated herein as "DNA119535-2756".

FIG. 352 shows the amino acid sequence (SEQ ID NO:352) derived from the coding sequence of SEQ ID NO:351 shown in FIG. 351.

FIG. 353 shows a nucleotide sequence (SEQ ID NO:353) of a native sequence PRO10096 cDNA, wherein SEQ ID NO:353 is a clone designated herein as "DNA125185-2806".

FIG. 354 shows the amino acid sequence (SEQ ID NO:354) derived from the coding sequence of SEQ ID NO:353 shown in FIG. 353.

FIG. 355 shows a nucleotide sequence (SEQ ID NO:355) of a native sequence PRO19670 cDNA, wherein SEQ ID NO:355 is a clone designated herein as "DNA131639-2874".

FIG. 356 shows the amino acid sequence (SEQ ID NO:356) derived from the coding sequence of SEQ ID NO:355 shown in FIG. 355.

FIG. 357 shows a nucleotide sequence (SEQ ID NO:357) of a native sequence PRO20044 cDNA, wherein SEQ ID NO:357 is a clone designated herein as "DNA139623-2893".

FIG. 358 shows the amino acid sequence (SEQ ID NO:358) derived from the coding sequence of SEQ ID NO:357 shown in FIG. 357.

FIG. 359 shows a nucleotide sequence (SEQ ID NO:359) of a native sequence PRO9873 cDNA, wherein SEQ ID NO:359 is a clone designated herein as "DNA143076-2787".

FIG. 360 shows the amino acid sequence (SEQ ID NO:360) derived from the coding sequence of SEQ ID NO:359 shown in FIG. 359.

FIG. 361 shows a nucleotide sequence (SEQ ID NO:361) of a native sequence PRO21366 cDNA, wherein SEQ ID NO:361 is a clone designated herein as "DNA143276-2975".

FIG. 362 shows the amino acid sequence (SEQ ID NO:362) derived from the coding sequence of SEQ ID NO:361 shown in FIG. 361.

FIG. 363 shows a nucleotide sequence (SEQ ID NO:363) of a native sequence PRO20040 cDNA, wherein SEQ ID NO:363 is a clone designated herein as "DNA164625-2890".

FIG. 364 shows the amino acid sequence (SEQ ID NO:364) derived from the coding sequence of SEQ ID NO:363 shown in FIG. 363.

FIG. 365 shows a nucleotide sequence (SEQ ID NO:365) of a native sequence PRO21184 cDNA, wherein SEQ ID NO:365 is a clone designated herein as "DNA167678-2963".

FIG. 366 shows the amino acid sequence (SEQ ID NO:366) derived from the coding sequence of SEQ ID NO:365 shown in FIG. 365.

FIG. 367 shows a nucleotide sequence (SEQ ID NO:367) of a native sequence PRO21055 cDNA, wherein SEQ ID NO:367 is a clone designated herein as "DNA170021-2923".

FIG. 368 shows the amino acid sequence (SEQ ID NO:368) derived from the coding sequence of SEQ ID NO:367 shown in FIG. 367.

FIG. 369 shows a nucleotide sequence (SEQ ID NO:369) of a native sequence PRO28631 cDNA, wherein SEQ ID NO:369 is a clone designated herein as "DNA170212-3000".

FIG. 370 shows the amino acid sequence (SEQ ID NO:370) derived from the coding sequence of SEQ ID NO:369 shown in FIG. 369.

FIG. 371 shows a nucleotide sequence (SEQ ID NO:371) of a native sequence PRO21384 cDNA, wherein SEQ ID NO:371 is a clone designated herein as "DNA177313-2982".

FIG. 372 shows the amino acid sequence (SEQ ID NO:372) derived from the coding sequence of SEQ ID NO:371 shown in FIG. 371.

FIG. 373 shows a nucleotide sequence (SEQ ID NO:373) of a native sequence PRO1449 cDNA, wherein SEQ ID NO:373 is a clone designated herein as "DNA64908-1163-1".

FIG. 374 shows the amino acid sequence (SEQ ID NO:374) derived from the coding sequence of SEQ ID NO:373 shown in FIG. 373.

Figure 375:
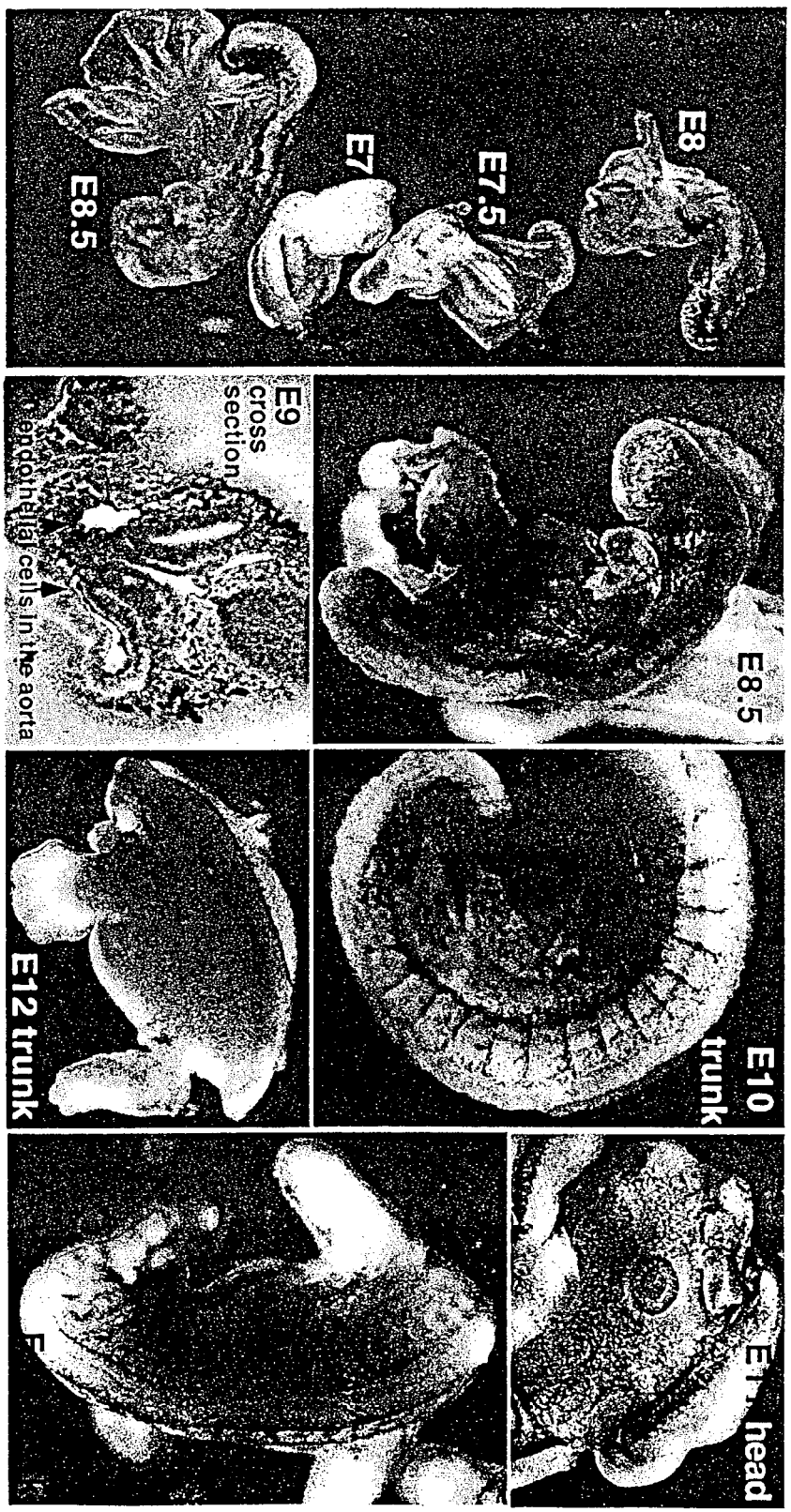

FIG. 375 shows whole mount in situ hybridization results on mouse embryos using a mouse orthologue of PRO1449 which has about 78% amino acid identity with PRO1449. The results show that PRO1449 orthologue is expressed in the developing vasculature. The cross-section further shows expression in endothelial cells and progenitors of endothelial cells.

FIG. 376 shows that a PRO1449 orthologue having about 78% amino acid identity with PRO1449 is expressed in vasculature of many inflamed and diseased tissues, but is very low, or lacking, in normal adult vessels.

Figure 377:
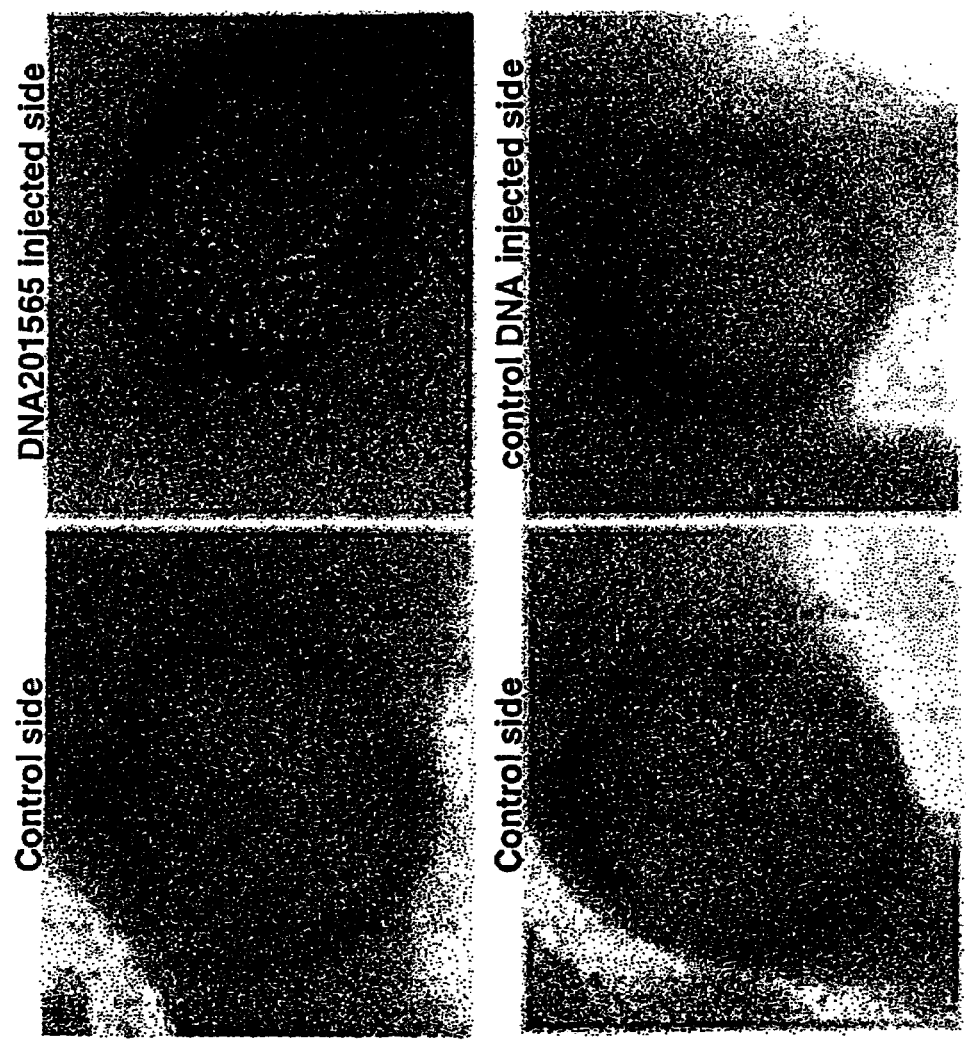

FIG. 377 shows that a PRO1449 orthologue having about 78% amino acid identity with PRO1449 induces ectopic vessels in the eyes of chicken embryos.

5. DETAILED DESCRIPTION OF THE INVENTION

5.1. Definitions

The phrases "cardiovascular, endothelial and angiogenic disorder", "cardiovascular, endothelial and angiogenic dysfunction", "cardiovascular, endothelial or angiogenic disorder" and "cardiovascular, endothelial or angiogenic dysfunction" are used interchangeably and refer in part to systemic disorders that affect vessels, such as diabetes mellitus, as well as diseases of the vessels themselves, such as of the arteries, capillaries, veins, and/or lymphatics. This would include indications that stimulate angiogenesis and/or cardiovascularization, and those that inhibit angiogenesis and/or cardiovascularization. Such disorders include, for example, arterial disease, such as atherosclerosis, hypertension, inflammatory vasculitides, Reynaud's disease and Reynaud's phenomenon, aneurysms, and arterial restenosis; venous and lymphatic disorders such as thrombophlebitis, lymphangitis, and lymphedema; and other vascular disorders such as peripheral vascular disease, cancer such as vascular tumors, e.g., hemangioma (capillary and cavernous), glomus tumors, telangiectasia, bacillary angiomatosis, hemangioendothelioma, angiosarcoma, haemangiopericytoma, Kaposi's sarcoma, lymphangioma, and lymphangiosarcoma, tumor angiogenesis, trauma such as wounds, burns, and other injured tissue, implant fixation, scarring, ischemia reperfusion injury, rheumatoid arthritis, cerebrovascular disease, renal diseases such as acute renal failure, and osteoporosis. This would also include angina, myocardial infarctions such as acute myocardial infarctions, cardiac hypertrophy, and heart failure such as CHF.

"Hypertrophy", as used herein, is defined as an increase in mass of an organ or structure independent of natural growth that does not involve tumor formation. Hypertrophy of an organ or tissue is due either to an increase in the mass of the individual cells (true hypertrophy), or to an increase in the number of cells making up the tissue (hyperplasia), or both. Certain organs, such as the heart, lose the ability to divide shortly after birth. Accordingly, "cardiac hypertrophy" is defined as an increase in mass of the heart, which, in adults, is characterized by an increase in myocyte cell size and contractile protein content without concomitant cell division. The character of the stress responsible for inciting the hypertrophy, (e.g., increased preload, increased afterload, loss of myocytes, as in myocardial infarction, or primary depression of contractility), appears to play a critical role in determining the nature of the response. The early stage of cardiac hypertrophy is usually characterized morphologically by increases in the size of myofibrils and mitochondria, as well as by enlargement of mitochondria and nuclei. At this stage, while muscle cells are larger than normal, cellular organization is largely preserved. At a more advanced stage of cardiac hypertrophy, there are preferential increases in the size or number of specific organelles, such as mitochondria, and new contractile elements are added in localized areas of the cells, in an irregular manner. Cells subjected to long-standing hypertrophy show more obvious disruptions in cellular organization, including markedly enlarged nuclei with highly lobulated membranes, which displace adjacent myofibrils and cause breakdown of normal Z-band registration. The phrase "cardiac hypertrophy" is used to include all stages of the progression of this condition, characterized by various degrees of structural damage of the heart muscle, regardless of the underlying cardiac disorder. Hence, the term also includes physiological conditions instrumental in the development of cardiac hypertrophy, such as elevated blood pressure, aortic stenosis, or myocardial infarction.

"Heart failure" refers to an abnormality of cardiac function where the heart does not pump blood at the rate needed for the requirements of metabolizing tissues. The heart failure can be caused by a number of factors, including ischemic, congenital, rheumatic, or idiopathic forms.

"Congestive heart failure" (CHF) is a progressive pathologic state where the heart is increasingly unable to supply adequate cardiac output (the volume of blood pumped by the heart over time) to deliver the oxygenated blood to peripheral tissues. As CHF progresses, structural and hemodynamic damages occur. While these damages have a variety of manifestations, one characteristic symptom is ventricular hypertrophy. CHF is a common end result of a number of various cardiac disorders.

"Myocardial infarction" generally results from atherosclerosis of the coronary arteries, often with superimposed coronary thrombosis. It may be divided into two major types: transmural infarcts, in which myocardial necrosis involves the full thickness of the ventricular wall, and subendocardial (nontransmural) infarcts, in which the necrosis involves the subendocardium, the intramural myocardium, or both, without extending all the way through the ventricular wall to the epicardium. Myocardial infarction is known to cause both a change in hemodynamic effects and an alteration in structure in the damaged and healthy zones of the heart. Thus, for example, myocardial infarction reduces the maximum cardiac output and the stroke volume of the heart. Also associated with myocardial infarction is a stimulation of the DNA synthesis occurring in the interstice as well as an increase in the formation of collagen in the areas of the heart not affected.

As a result of the increased stress or strain placed on the heart in prolonged hypertension due, for example, to the increased total peripheral resistance, cardiac hypertrophy has long been associated with "hypertension". A characteristic of the ventricle that becomes hypertrophic as a result of chronic pressure overload is an impaired diastolic performance. Fouad et al., *J. Am. Coll. Cardiol.,* 4: 1500–1506 (1984); Smith et al., *J. Am. Coll. Cardiol.,* 5: 869–874 (1985). A prolonged left ventricular relaxation has been detected in early essential hypertension, in spite of normal or supranormal systolic function. Hartford et al., *Hypertension,* 6: 329–338 (1984). However, there is no close parallelism between blood pressure levels and cardiac hypertrophy. Although improvement in left ventricular function in response to antihypertensive therapy has been reported in humans, patients variously treated with a diuretic (hydrochlorothiazide), a β-blocker (propranolol), or a calcium channel blocker (diltiazem), have shown reversal of left ventricular hypertrophy, without improvement in diastolic function. Inouye et al., *Am. J. Cardiol.,* 53: 1583–7 (1984).

Another complex cardiac disease associated with cardiac hypertrophy is "hypertrophic cardiomyopathy". This condition is characterized by a great diversity of morphologic, functional, and clinical features (Maron et al., *N. Engl. J. Med.,* 316: 780–789 (1987); Spirito et al., *N. Engl. J. Med.,* 320: 749–755 (1989); Louie and Edwards, *Prog. Cardiovasc. Dis.,* 36: 275–308 (1994); Wigle et al., *Circulation,* 92: 1680–1692 (1995)), the heterogeneity of which is accentuated by the fact that it afflicts patients of all ages. Spirito et al., *N. Engl. J. Med.,* 336: 775–785 (1997). The causative factors of hypertrophic cardiomyopathy are also diverse and little understood. In general, mutations in genes encoding sarcomeric proteins are associated with hypertrophic cardiomyopathy. Recent data suggest that β-myosin heavy chain mutations may account for approximately 30 to 40 percent of cases of familial hypertrophic cardiomyopathy. Watkins et al., *N. Engl. J. Med.,* 326: 1108–1114(1992); Schwartz et al, *Circulation,* 91: 532–540 (1995); Marian and Roberts, *Circulation,* 92: 1336–1347 (1995); Thierfelder et al., *Cell,* 77: 701–712 (1994); Watkins et al., *Nat. Gen.,* 11: 434–437 (1995). Besides β-myosin heavy chain, other locations of genetic mutations include cardiac troponin T, alpha topomyosin, cardiac myosin binding protein C, essential myosin light chain, and regulatory myosin light chain. See, Malik and Watkins, *Curr. Opin. Cardiol.,* 12: 295–302 (1997).

Supravalvular "aortic stenosis" is an inherited vascular disorder characterized by narrowing of the ascending aorta, but other arteries, including the pulmonary arteries, may also be affected. Untreated aortic stenosis may lead to increased intracardiac pressure resulting in myocardial hypertrophy and eventually heart failure and death. The pathogenesis of this disorder is not fully understood, but hypertrophy and possibly hyperplasia of medial smooth muscle are prominent features of this disorder. It has been reported that molecular variants of the elastin gene are involved in the development and pathogenesis of aortic stenosis. U.S. Pat. No. 5,650,282 issued Jul. 22, 1997.

"Valvular regurgitation" occurs as a result of heart diseases resulting in disorders of the cardiac valves. Various diseases, like rheumatic fever, can cause the shrinking or pulling apart of the valve orifice, while other diseases may result in endocarditis, an inflammation of the endocardium or lining membrane of the atrioventricular orifices and operation of the heart. Defects such as the narrowing of the valve stenosis or the defective closing of the valve result in an accumulation of blood in the heart cavity or regurgitation of blood past the valve. If uncorrected, prolonged valvular stenosis or insufficiency may result in cardiac hypertrophy and associated damage to the heart muscle, which may eventually necessitate valve replacement.

The treatment of all these, and other cardiovascular, endothelial and angiogenic disorders, which may or may not be accompanied by cardiac hypertrophy, is encompassed by the present invention.

The terms "cancer", "cancerous", and "malignant" refer to or describe the physiological condition in mammals that is typically characterized by unregulated cell growth. Examples of cancer include but are not limited to, carcinoma including adenocarcinoma, lymphoma, blastoma, melanoma, sarcoma, and leukemia. More particular examples of such cancers include squamous cell cancer, small-cell lung cancer, non-small cell lung cancer, gastrointestinal cancer, Hodgkin's and non-Hodgkin's lymphoma, pancreatic cancer, glioblastoma, cervical cancer, ovarian cancer, liver cancer such as hepatic carcinoma and hepatoma, bladder cancer, breast cancer, colon cancer, colorectal cancer, endometrial carcinoma, salivary gland carcinoma, kidney cancer such as renal cell carcinoma and Wilms' tumors, basal cell carcinoma, melanoma, prostate cancer, vulval cancer, thyroid cancer, testicular cancer, esophageal cancer, and various types of head and neck cancer. The preferred cancers for treatment herein are breast, colon, lung, melanoma, ovarian, and others involving vascular tumors as noted above.

The term "cytotoxic agent" as used herein refers to a substance that inhibits or prevents the function of cells and/or causes destruction of cells. The term is intended to include radioactive isotopes (e.g., $^{131}I$, $^{125}I$, $^{90}Y$, and $^{186}Re$), chemotherapeutic agents, and toxins such as enzymatically active toxins of bacterial, fungal, plant, or animal origin, or fragments thereof.

A "chemotherapeutic agent" is a chemical compound useful in the treatment of cancer. Examples of chemotherapeutic agents include alkylating agents, folic acid antagonists, anti-metabolites of nucleic acid metabolism, antibiotics, pyrimidine analogs, 5-fluorouracil, cisplatin, purine nucleosides, amines, amino acids, triazol nucleosides, or corticosteroids. Specific examples include Adriamycin, Doxorubicin, 5-Fluorouracil, Cytosine arabinoside ("Ara-C"), Cyclophosphamide, Thiotepa, Busulfan, Cytoxin, Taxol, Toxotere, Methotrexate, Cisplatin, Melphalan, Vinblastine, Bleomycin, Etoposide, Ifosfamide, Mitomycin C, Mitoxantrone, Vincreistine, Vinorelbine, Carboplatin, Teniposide, Daunomycin, Caminomycin, Aminopterin, Dactinomycin, Mitomycins, Esperamicins (see U.S. Pat. No. 4,675,187), Melphalan, and other related nitrogen mustards. Also included in this definition are hormonal agents that act to regulate or inhibit hormone action on tumors, such as tamoxifen and onapristone.

A "growth-inhibitory agent" when used herein refers to a compound or composition that inhibits growth of a cell, such as an Wnt-overexpressing cancer cell, either in vitro or in vivo. Thus, the growth-inhibitory agent is one which significantly reduces the percentage of malignant cells in S phase. Examples of growth-inhibitory agents include agents that block cell cycle progression (at a place other than S phase), such as agents that induce G1 arrest and M-phase arrest. Classical M-phase blockers include the vincas (vincristine and vinblastine), taxol, and topo II inhibitors such as doxorubicin, daunorubicin, etoposide, and bleomycin. Those agents that arrest G1 also spill over into S-phase arrest, for example, DNA alkylating agents such as tamoxifen, prednisone, dacarbazine, mechlorethamine, cisplatin, methotrexate, 5-fluorouracil, and ara-C. Further information can be found in *The Molecular Basis of Cancer*, Mendelsohn and Israel, eds., Chapter 1, entitled "Cell cycle regulation, oncogenes, and antineoplastic drugs" by Murakami et al. (W B Saunders: Philadelphia, 1995), especially p. 13. Additional examples include tumor necrosis factor (TNF), an antibody capable of inhibiting or neutralizing the angiogenic activity of acidic or basic FGF or hepatocyte growth factor (HGF), an antibody capable of inhibiting or neutralizing the coagulant activities of tissue factor, protein C, or protein S (see, WO 91/01753, published Feb. 21, 1991), or an antibody capable of binding to HER2 receptor (WO 89/06692), such as the 4D5 antibody (and functional equivalents thereof) (e.g., WO 92/22653).

"Treatment" is an intervention performed with the intention of preventing the development or altering the pathology of a cardiovascular, endothelial, and angiogenic disorder.

The concept of treatment is used in the broadest sense, and specifically includes the prevention (prophylaxis), moderation, reduction, and curing of cardiovascular, endothelial, and angiogenic disorders of any stage. Accordingly, "treatment" refers to both therapeutic treatment and prophylactic or preventative measures, wherein the object is to prevent or slow down (lessen) or ameliorate a cardiovascular, endothelial, and angiogenic disorder such as hypertrophy. Those in need of treatment include those already with the disorder as well as those prone to have the disorder or those in whom the disorder is to be prevented. The disorder may result from any cause, including idiopathic, cardiotrophic, or myotrophic causes, or ischemia or ischemic insults, such as myocardial infarction.

"Chronic" administration refers to administration of the agent(s) in a continuous mode as opposed to an acute mode, so as to maintain the initial effect, such as an anti-hypertrophic effect, for an extended period of time.

"Mammal" for purposes of treatment refers to any animal classified as a mammal, including humans, domestic and farm animals, and zoo, sports, or pet animals, such as dogs, horses, cats, cows, sheep, pigs, etc. Preferably, the mammal is human.

Administration "in combination with" one or more further therapeutic agents includes simultaneous (concurrent) and consecutive administration in any order.

The phrase "cardiovascular, endothelial or angiogenic agents" refers generically to any drug that acts in treating cardiovascular, endothelial, and angiogenic disorders. Examples of cardiovascular agents are those that promote vascular homeostasis by modulating blood pressure, heart rate, heart contractility, and endothelial and smooth muscle biology, all of which factors have a role in cardiovascular disease. Specific examples of these include angiotensin-II receptor antagonists; endothelin receptor antagonists such as, for example, BOSENTAN™ and MOXONODIN™; interferon-gamma (IFN-γ); des-aspartate-angiotensin I; thrombolytic agents, e.g., streptokinase, urokinase, t-PA, and a t-PA variant specifically designed to have longer half-life and very high fibrin specificity, TNK t-PA (a T103N, N117Q, KHRR(296–299)AAAA t-PA variant, Keyt et al., *Proc. Natl. Acad. Sci. USA,* 91: 3670–3674 (1994)); inotropic or hypertensive agents such as digoxigenin and β-adrenergic receptor blocking agents, e.g., propranolol, timolol, tertalolol, carteolol, nadolol, betaxolol, penbutolol, acetobutolol, atenolol, metoprolol, and carvedilol; angiotensin converting enzyme (ACE) inhibitors, e.g., quinapril, captopril, enalapril, ramipril, benazepril, fosinopril, and lisinopril; diuretics, e.g., chlorothiazide, hydrochlorothiazide, hydroflumethazide, methylchlothiazide, benzthiazide, dichlorphenamide, acetazolamide, and indapamide; and calcium channel blockers, e.g., diltiazem, nifedipine, verapamil, nicardipine. One preferred category of this type is a therapeutic agent used for the treatment of cardiac hypertrophy or of a physiological condition instrumental in the development of cardiac hypertrophy, such as elevated blood pressure, aortic stenosis, or myocardial infarction.

"Angiogenic agents" and "endothelial agents" are active agents that promote angiogenesis and/or endothelial cell growth, or, if applicable, vasculogenesis. This would include factors that accelerate wound healing, such as growth hormone, insulin-like growth factor-I (IGF-I), VEGF, VIGF, PDGF, epidermal growth factor (EGF), CTGF and members of its family, FGF, and TGF-α and TGF-β.

"Angiostatic agents" are active agents that inhibit angiogenesis or vasculogenesis or otherwise inhibit or prevent growth of cancer cells. Examples include antibodies or other antagonists to angiogenic agents as defined above, such as antibodies to VEGF. They additionally include cytotherapeutic agents such as cytotoxic agents, chemotherapeutic agents, growth-inhibitory agents, apoptotic agents, and other agents to treat cancer, such as anti-HER-2, anti-CD20, and other bioactive and organic chemical agents.

In a pharmacological sense, in the context of the present invention, a "therapeutically effective amount" of an active agent such as a PRO polypeptide or agonist or antagonist thereto or an anti-PRO antibody, refers to an amount effective in the treatment of a cardiovascular, endothelial or angiogenic disorder in a mammal and can be determined empirically.

As used herein, an "effective amount" of an active agent such as a PRO polypeptide or agonist or antagonist thereto or an anti-PRO antibody, refers to an amount effective for carrying out a stated purpose, wherein such amounts may be determined empirically for the desired effect.

The terms "PRO polypeptide" and "PRO" as used herein and when immediately followed by a numerical designation refer to various polypeptides, wherein the complete designation (i.e., PRO/number) refers to specific polypeptide sequences as described herein. The terms "PRO/number polypeptide" and "PRO/number" wherein the term "number" is provided as an actual numerical designation as used herein encompass native sequence polypeptides and polypeptide variants (which are further defined herein). The PRO polypeptides described herein may be isolated from a variety of sources, such as from human tissue types or from another source, or prepared by recombinant or synthetic methods.

A "native sequence PRO polypeptide" comprises a polypeptide having the same amino acid sequence as the corresponding PRO polypeptide derived from nature. Such native sequence PRO polypeptides can be isolated from nature or can be produced by recombinant or synthetic means. The term "native sequence PRO polypeptide" specifically encompasses naturally-occurring truncated or secreted forms of the specific PRO polypeptide (e.g., an extracellular domain sequence), naturally-occurring variant forms (e.g., alternatively spliced forms) and naturally-occurring allelic variants of the polypeptide. In various embodiments of the invention, the native sequence PRO polypeptides disclosed herein are mature or full-length native sequence polypeptides comprising the full-length amino acids sequences shown in the accompanying figures. Start and stop codons are shown in bold font and underlined in the figures. However, while the PRO polypeptide disclosed in the accompanying figures are shown to begin with methionine residues designated herein as amino acid position 1 in the figures, it is conceivable and possible that other methionine residues located either upstream or downstream from the amino acid position 1 in the figures may be employed as the starting amino acid residue for the PRO polypeptides.

The PRO polypeptide "extracellular domain" or "ECD" refers to a form of the PRO polypeptide which is essentially free of the transmembrane and cytoplasmic domains. Ordinarily, a PRO polypeptide ECD will have less than 1% of such transmembrane and/or cytoplasmic domains and preferably, will have less than 0.5% of such domains. It will be understood that any transmembrane domains identified for the PRO polypeptides of the present invention are identified pursuant to criteria routinely employed in the art for identifying that type of hydrophobic domain. The exact boundaries of a transmembrane domain may vary but most likely by no more than about 5 amino acids at either end of the domain as initially identified herein. Optionally, therefore, an extracellular domain of a PRO polypeptide may contain from about 5 or fewer amino acids on either side of the transmembrane domain/extracellular domain boundary as identified in the Examples or specification and such polypeptides, with or without the associated signal peptide, and nucleic acid encoding them, are comtemplated by the present invention.

The approximate location of the "signal peptides" of the various PRO polypeptides disclosed herein are shown in the present specification and/or the accompanying figures. It is noted, however, that the C-terminal boundary of a signal peptide may vary, but most likely by no more than about 5 amino acids on either side of the signal peptide C-terminal boundary as initially identified herein, wherein the C-terminal boundary of the signal peptide may be identified pursuant to criteria routinely employed in the art for identifying that type of amino acid sequence element (e.g., Nielsen et al., *Prot. Eng.*, 10:1–6 (1997) and von Heinje et al., *Nucl. Acids Res.*, 14:4683–4690 (1986)). Moreover, it is also recognized that, in some cases, cleavage of a signal sequence from a secreted polypeptide is not entirely uniform, resulting in more than one secreted species. These mature polypeptides, where the signal peptide is cleaved within no more than about 5 amino acids on either side of the C-terminal boundary of the signal peptide as identified herein, and the polynucleotides encoding them, are contemplated by the present invention.

"PRO polypeptide variant" means an active PRO polypeptide as defined above or below having at least about 80% amino acid sequence identity with a full-length native sequence PRO polypeptide sequence as disclosed herein, a PRO polypeptide sequence lacking the signal peptide as disclosed herein, an extracellular domain of a PRO polypeptide, with or without the signal peptide, as disclosed herein or any other fragment of a full-length PRO polypeptide sequence as disclosed herein. Such PRO polypeptide variants include, for instance, PRO polypeptides wherein one or more amino acid residues are added, or deleted, at the N- or C-terminus of the full-length native amino acid sequence. Ordinarily, a PRO polypeptide variant will have at least about 80%, 81%, 82%, 83%, 84%, 85%, 86%, 87%, 88%, 89%, 90%, 91%, 92%, 93%, 94%, 95%, 96%, 97% or 98% amino acid sequence identity and alternatively at least about 99% amino acid sequence identity to a full-length native sequence PRO polypeptide sequence as disclosed herein, a PRO polypeptide sequence lacking the signal peptide as disclosed herein, an extracellular domain of a PRO polypeptide, with or without the signal peptide, as disclosed herein or any other specifically defined fragment of a full-length PRO polypeptide sequence as disclosed herein. Ordinarily, PRO variant polypeptides are at least about 10, 20, 30, 40, 50, 60, 70, 80, 90, 100, 150 or 200 amino acids in length and alternatively at least about 300 amino acids in length, or more.

"Percent (%) amino acid sequence identity" with respect to the PRO polypeptide sequences identified herein is defined as the percentage of amino acid residues in a candidate sequence that are identical with the amino acid residues in a PRO sequence, after aligning the sequences and introducing gaps, if necessary, to achieve the maximum percent sequence identity, and not considering any conservative substitutions as part of the sequence identity. Alignment for purposes of determining percent amino acid sequence identity can be achieved in various ways that are within the skill in the art, for instance, using publicly available computer software such as BLAST, BLAST-2, ALIGN, ALIGN-2 or Megalign (DNASTAR) software. Those skilled in the art can determine appropriate parameters for measuring alignment, including any algorithms needed to achieve maximal alignment over the full-length of the sequences being compared. For purposes herein, however, % amino acid sequence identity values are obtained as described below by using the sequence comparison computer program ALIGN-2, wherein the complete source code for the ALIGN-2 program is provided in Table 1. The ALIGN-2 sequence comparison computer program was authored by Genentech, Inc., and the source code shown in Table 1 has been filed with user documentation in the U.S. Copyright Office, Washington D.C., 20559, where it is registered under U.S. Copyright Registration No. TXU510087. The ALIGN-2 program is publicly available through Genentech, Inc., South San Francisco, Calif. or may be compiled from the source code provided in Table 1. The ALIGN-2 program should be compiled for use on a UNIX operating system, preferably digital UNIX V4.0D. All sequence comparison parameters are set by the ALIGN-2 program and do not vary.

For purposes herein, the % amino acid sequence identity of a given amino acid sequence A to, with, or against a given amino acid sequence B (which can alternatively be phrased as a given amino acid sequence A that has or comprises a certain % amino acid sequence identity to, with, or against a given amino acid sequence B) is calculated as follows:

100 times the fraction X/Y where X is the number of amino acid residues scored as identical matches by the sequence alignment program ALIGN-2 in that program's alignment of A and B, and where Y is the total number of amino acid residues in B.

It will be appreciated that where the length of amino acid sequence A is not equal to the length of amino acid sequence B, the % amino acid sequence identity of A to B will not equal the % amino acid sequence identity of B to A. As examples of % amino acid sequence identity calculations, Tables 2–3 demonstrate how to calculate the % amino acid sequence identity of the amino acid sequence designated "Comparison Protein" to the amino acid sequence designated "PRO".

Unless specifically stated otherwise, all % amino acid sequence identity values used herein are obtained as described above using the ALIGN-2 sequence comparison computer program. However, % amino acid sequence identity may also be determined using the sequence comparison program NCBI-BLAST2 (Altschul et al., *Nucleic Acids Res.*, 25:3389–3402 (1997)). The NCBI-BLAST2 sequence comparison program may be obtained from the National Institute of Health, Bethesda, Md. NCBI-BLAST2 uses several search parameters, wherein all of those search parameters are set to default values including, for example, unmask=yes, strand=all, expected occurrences=10, minimum low complexity length=15/5, multi-pass e-value=0.01, constant for multi-pass=25, dropoff for final gapped alignment=25 and scoring matrix=BLOSUM62.

In situations where NCBI-BLAST2 is employed for amino acid sequence comparisons, the % amino acid sequence identity of a given amino acid sequence A to, with, or against a given amino acid sequence B (which can alternatively be phrased as a given amino acid sequence A that has or comprises a certain % amino acid sequence identity to, with, or against a given amino acid sequence B) is calculated as follows:

100 times the fraction X/Y where X is the number of amino acid residues scored as identical matches by the sequence alignment program NCBI-BLAST2 in that program's alignment of A and B, and where Y is the total number of amino acid residues in B. It will be appreciated that where the length of amino acid sequence A is not equal to the length of amino acid sequence B, the % amino acid sequence identity of A to B will not equal the % amino acid sequence identity of B to A.

In addition, % amino acid sequence identity may also be determined using the WU-BLAST-2 computer program (Altschul et al., *Methods in Enzymology*, 266:460–480 (1996)). Most of the WU-BLAST-2 search parameters are set to the default values. Those not set to default values, i.e., the adjustable parameters, are set with the following values: overlap span=1, overlap fraction=0.125, word threshold (T)=11, and scoring matrix=BLOSUM62. For purposes herein, a % amino acid sequence identity value is determined by dividing (a) the number of matching identical amino acids residues between the amino acid sequence of the PRO polypeptide of interest having a sequence derived from the native PRO polypeptide and the comparison amino acid sequence of interest (i.e., the sequence against which the PRO polypeptide of interest is being compared which may be a PRO variant polypeptide) as determined by WU-BLAST-2 by (b) the total number of amino acid residues of the PRO polypeptide of interest. For example, in the statement "a polypeptide comprising an amino acid sequence A which has or having at least 80% amino acid sequence identity to the amino acid sequence B", the amino acid sequence A is the comparison amino acid sequence of interest and the amino acid sequence B is the amino acid sequence of the PRO polypeptide of interest.

"PRO variant polynucleotide" or "PRO variant nucleic acid sequence" means a nucleic acid molecule which encodes an active PRO polypeptide as defined below and which has at least about 80% nucleic acid sequence identity with a nucleotide acid sequence encoding a full-length native sequence PRO polypeptide sequence as disclosed herein, a full-length native sequence PRO polypeptide sequence lacking the signal peptide as disclosed herein, an extracellular domain of a PRO polypeptide, with or without the signal peptide, as disclosed herein or any other fragment of a full-length PRO polypeptide sequence as disclosed herein. Ordinarily, a PRO variant polynucleotide will have at least about 80%, 81%, 82%, 83%, 84%, 85%, 86%, 87%, 88%, 89%, 90%, 91%, 92%, 93%, 94%, 95%, 96%, 97% or 98% nucleic acid sequence identity and alternatively at least about 99% nucleic acid sequence identity with a nucleic acid sequence encoding a full-length native sequence PRO polypeptide sequence as disclosed herein, a full-length native sequence PRO polypeptide sequence lacking the signal peptide as disclosed herein, an extracellular domain of a PRO polypeptide, with or without the signal sequence, as disclosed herein or any other fragment of a full-length PRO polypeptide sequence as disclosed herein. Variants do not encompass the native nucleotide sequence.

Ordinarily, PRO variant polynucleotides are at least about 30, 60, 90, 120, 150, 180, 210, 240, 270, 300, 450, or 600 nucleotides in length and alternatively at least about 900 nucleotides in length, or more.

"Percent (%) nucleic acid sequence identity" with respect to the PRO polypeptide-encoding nucleic acid sequences identified herein is defined as the percentage of nucleotides in a candidate sequence that are identical with the nucleotides in a PRO polypeptide-encoding nucleic acid sequence, after aligning the sequences and introducing gaps, if necessary, to achieve the maximum percent sequence identity. Alignment for purposes of determining percent nucleic acid sequence identity can be achieved in various ways that are within the skill in the art, for instance, using publicly available computer software such as BLAST, BLAST-2, ALIGN, ALIGN-2 or Megalign (DNASTAR) software. Those skilled in the art can determine appropriate parameters for measuring alignment, including any algorithms needed to achieve maximal alignment over the full-length of the sequences being compared. For purposes herein, however, % nucleic acid sequence identity values are obtained as described below by using the sequence comparison computer program ALIGN-2, wherein the complete source code for the ALIGN-2 program is provided in Table 1. The ALIGN-2 sequence comparison computer program was authored by Genentech, Inc., and the source code shown in Table 1 has been filed with user documentation in the U.S. Copyright Office, Washington D.C., 20559, where it is registered under U.S. Copyright Registration No. TXU510087. The ALIGN-2 program is publicly available through Genentech, Inc., South San Francisco, Calif. or may be compiled from the source code provided in Table 1. The ALIGN-2 program should be compiled for use on a UNIX operating system, preferably digital UNIX V4.0D. All sequence comparison parameters are set by the ALIGN-2 program and do not vary.

For purposes herein, the % nucleic acid sequence identity of a given nucleic acid sequence C to, with, or against a given nucleic acid sequence D (which can alternatively be phrased as a given nucleic acid sequence C that has or comprises a certain % nucleic acid sequence identity to, with, or against a given nucleic acid sequence D) is calculated as follows:

100 times the fraction W/Z where W is the number of nucleotides scored as identical matches by the sequence alignment program ALIGN-2 in that program's alignment of C and D, and where Z is the total number of nucleotides in D. It will be appreciated that where the length of nucleic acid sequence C is not equal to the length of nucleic acid sequence D, the % nucleic acid sequence identity of C to D will not equal the % nucleic acid sequence identity of D to C. As examples of % nucleic acid sequence identity calculations, Tables 4–5 demonstrate how to calculate the % nucleic acid sequence identity of the nucleic acid sequence designated "Comparison DNA" to the nucleic acid sequence designated "PRO-DNA".

Unless specifically stated otherwise, all % nucleic acid sequence identity values used herein are obtained as described above using the ALIGN-2 sequence comparison computer program. However, % nucleic acid sequence identity may also be determined using the sequence comparison program NCBI-BLAST2 (Altschul et al., *Nucleic Acids Res.*, 25:3389–3402 (1997)). The NCBI-BLAST2 sequence comparison program may be obtained from the National Institute of Health, Bethesda, MD. NCBI-BLAST2 uses several search parameters, wherein all of those search parameters are set to default values including, for example, unmask=yes, strand=all, expected occurrences=10, minimum low complexity length=15/5, multi-pass e-value=0.01, constant for multi-pass=25, dropoff for final gapped alignment=25 and scoring matrix=BLOSUM62.

In situations where NCBI-BLAST2 is employed for sequence comparisons, the % nucleic acid sequence identity of a given nucleic acid sequence C to, with, or against a given nucleic acid sequence D (which can alternatively be phrased as a given nucleic acid sequence C that has or comprises a certain % nucleic acid sequence identity to, with, or against a given nucleic acid sequence D) is calculated as follows:

$$100 \text{ times the fraction } W/Z$$

where W is the number of nucleotides scored as identical matches by the sequence alignment program NCBI-BLAST2 in that program's alignment of C and D, and where Z is the total number of nucleotides in D. It will be appreciated that where the length of nucleic acid sequence C is not equal to the length of nucleic acid sequence D, the % nucleic acid sequence identity of C to D will not equal the % nucleic acid sequence identity of D to C.

In addition, % nucleic acid sequence identity values may also be generated using the WU-BLAST-2 computer program (Altschul et al., *Methods in Enzymology*, 266:460–480 (1996)). Most of the WU-BLAST-2 search parameters are set to the default values. Those not set to default values, i.e., the adjustable parameters, are set with the following values: overlap span=1, overlap fraction=0.125, word threshold (T)=11, and scoring matrix=BLOSUM62. For purposes herein, a % nucleic acid sequence identity value is determined by dividing (a) the number of matching identical nucleotides between the nucleic acid sequence of the PRO polypeptide-encoding nucleic acid molecule of interest having a sequence derived from the native sequence PRO polypeptide-encoding nucleic acid and the comparison nucleic acid molecule of interest (i.e., the sequence against which the PRO polypeptide-encoding nucleic acid molecule of interest is being compared which may be a variant PRO polynucleotide) as determined by WU-BLAST-2 by (b) the total number of nucleotides of the PRO polypeptide-encoding nucleic acid molecule of interest. For example, in the statement "an isolated nucleic acid molecule comprising a nucleic acid sequence A which has or having at least 80% nucleic acid sequence identity to the nucleic acid sequence B", the nucleic acid sequence A is the comparison nucleic acid molecule of interest and the nucleic acid sequence B is the nucleic acid sequence of the PRO polypeptide-encoding nucleic acid molecule of interest.

In other embodiments, PRO variant polynucleotides are nucleic acid molecules that encode an active PRO polypeptide and which are capable of hybridizing, preferably under stringent hybridization and wash conditions, to nucleotide sequences encoding the full-length PRO polypeptide as shown in the specification herein and accompanying figures. PRO variant polypeptides may be those that are encoded by a PRO variant polynucleotide.

"Isolated", when used to describe the various polypeptides disclosed herein, means a polypeptide that has been identified and separated and/or recovered from a component of its natural environment. Preferably, the isolated polypeptide is free of association with all components with which it is naturally associated. Contaminant components of its natural environment are materials that would typically interfere with diagnostic or therapeutic uses for the polypeptide, and may include enzymes, hormones, and other proteinaceous or non-proteinaceous solutes. In preferred embodiments, the polypeptide will be purified (1) to a degree sufficient to obtain at least 15 residues of N-terminal or internal amino acid sequence by use of a spinning cup sequenator, or (2) to homogeneity by SDS-PAGE under non-reducing or reducing conditions using Coomassie blue or, preferably, silver stain. Isolated polypeptide includes polypeptide in situ within recombinant cells, since at least one component of the PRO natural environment will not be present. Ordinarily, however, isolated polypeptide will be prepared by at least one purification step.

An "isolated" nucleic acid molecule encoding a PRO polypeptide or an "isolated" nucleic acid molecule encoding an anti-PRO antibody is a nucleic acid molecule that is identified and separated from at least one contaminant nucleic acid molecule with which it is ordinarily associated in the natural source of the PRO-encoding nucleic acid or the natural source of the anti-PRO-encoding nucleic acid. Preferably, the isolated nucleic acid is free of association with all components with which it is naturally associated. An isolated PRO-encoding nucleic acid molecule or an isolated anti-PRO-encoding nucleic acid molecule is other than in the form or setting in which it is found in nature. Isolated nucleic acid molecules therefore are distinguished from the PRO-encoding nucleic acid molecule or from the anti-PRO-encoding nucleic acid molecule as it exists in natural cells. However, an isolated nucleic acid molecule encoding a PRO polypeptide or an isolated nucleic acid molecule encoding an anti-PRO antibody includes PRO-nucleic acid molecules or anti-PRO-nucleic acid molecules contained in cells that ordinarily express PRO polypeptides or anti-PRO antibodies where, for example, the nucleic acid molecule is in a chromosomal location different from that of natural cells.

The term "control sequences" refers to DNA sequences necessary for the expression of an operably linked coding sequence in a particular host organism. The control sequences that are suitable for prokaryotes, for example, include a promoter, optionally an operator sequence, and a ribosome binding site. Eukaryotic cells are known to utilize, for example, promoters, polyadenylation signals, and enhancers.

Nucleic acid is "operably linked" when it is placed into a functional relationship with another nucleic acid sequence. For example, DNA for a presequence or secretory leader is operably linked to DNA for a PRO polypeptide if it is expressed as a preprotein that participates in the secretion of the polypeptide; a promoter or enhancer is operably linked to a coding sequence if it affects the transcription of the sequence; or a ribosome binding site is operably linked to a coding sequence if it is positioned so as to facilitate translation. Generally, "operably linked" means that the DNA sequences being linked are contiguous, and, in the case of a secretory leader, contiguous and in the same reading frame. However, enhancers do not have to be contiguous. Linking is accomplished by ligation at convenient restriction sites. If such sites do not exist, synthetic oligonucleotide adaptors or linkers are used in accordance with conventional practice.

"Stringency" of hybridization reactions is readily determinable by one of ordinary skill in the art, and generally is an empirical calculation dependent upon probe length, washing temperature, and salt concentration. In general, longer probes require higher temperatures for proper annealing, while shorter probes need lower temperatures. Hybridization generally depends on the ability of denatured DNA to reanneal when complementary strands are present in an environment below their melting temperature. The higher the degree of desired homology between the probe and hybridizable sequence, the higher the relative temperature that can be used. As a result, it follows that higher relative temperatures would tend to make the reaction conditions more stringent, while lower temperatures less so. For additional details and explanation of stringency of hybridization reactions, see, Ausubel et al., *Current Protocols in Molecular Biology* (Wiley Interscience Publishers, 1995).

"Stringent conditions" or "high-stringency conditions", as defined herein, may be identified by those that: (1) employ low ionic strength and high temperature for washing, for example, 0.015 M sodium chloride/0.0015 M sodium citrate/0.1% sodium dodecyl sulfate at 50° C.; (2) employ during hybridization a denaturing agent, such as formamide, for example, 50% (v/v) formamide with 0.1% bovine serum albumin/0.1% Ficoll/0.1% polyvinylpyrrolidone/50 mM sodium phosphate buffer at pH 6.5 with 750 mM sodium chloride, 75 mM sodium citrate at 42° C.; or (3) employ 50% formamide, 5×SSC (0.75 M NaCl, 0.075 M sodium citrate), 50 mM sodium phosphate (pH 6.8), 0.1% sodium pyrophosphate, 5× Denhardt's solution, sonicated salmon sperm DNA (50 µg/ml), 0.1% SDS, and 10% dextran sulfate at 42° C., with washes at 42° C. in 0.2×SSC (sodium chloride/sodium citrate) and 50% formamide at 55° C., followed by a high-stringency wash consisting of 0.1×SSC containing EDTA at 55° C.

"Moderately-stringent conditions" may be identified as described by Sambrook et al., *Molecular Cloning: A Laboratory Manual* (New York: Cold Spring Harbor Press, 1989), and include the use of washing solution and hybridization conditions (e.g., temperature, ionic strength, and % SDS) less stringent than those described above. An example of moderately stringent conditions is overnight incubation at 37° C. in a solution comprising: 20% formamide, 5×SSC (150 mM NaCl, 15 mM trisodium citrate), 50 mM sodium phosphate (pH 7.6), 5× Denhardt's solution, 10% dextran sulfate, and 20 mg/ml denatured sheared salmon sperm DNA, followed by washing the filters in 1×SSC at about 37–50° C. The skilled artisan will recognize how to adjust the temperature, ionic strength, etc. as necessary to accommodate factors such as probe length and the like.

The modifier "epitope-tagged" when used herein refers to a chimeric polypeptide comprising a PRO polypeptide fused to a "tag polypeptide". The tag polypeptide has enough residues to provide an epitope against which an antibody can be made, yet is short enough such that it does not interfere with activity of the polypeptide to which it is fused. The tag polypeptide preferably also is fairly unique so that the antibody does not substantially cross-react with other epitopes. Suitable tag polypeptides generally have at least six amino acid residues and usually between about 8 and 50 amino acid residues (preferably, between about 10 and 20 amino acid residues).

"Active" or "activity" in the context of PRO variants refers to form(s) of PRO proteins that retain the biologic and/or immunologic activities of a native or naturally-occurring PRO polypeptide.

"Biological activity" in the context of a molecule that antagonizes a PRO polypeptide that can be identified by the screening assays disclosed herein (e.g., an organic or inorganic small molecule, peptide, etc.) is used to refer to the ability of such molecules to bind or complex with the PRO polypeptide identified herein, or otherwise interfere with the interaction of the PRO polypeptide with other cellular proteins or otherwise inhibits the transcription or translation of the PRO polypeptide. Particularly preferred biological activity includes cardiac hypertrophy, activity that acts on systemic disorders that affect vessels, such as diabetes mellitus, as well as diseases of the arteries, capillaries, veins, and/or lymphatics, and cancer.

The term "antagonist" is used in the broadest sense, and includes any molecule that partially or fully blocks, inhibits, or neutralizes one or more of the biological activities of a native PRO polypeptide disclosed herein, for example, if applicable, its mitogenic or angiogenic activity. Antagonists of a PRO polypeptide may act by interfering with the binding of a PRO polypeptide to a cellular receptor, by incapacitating or killing cells that have been activated by a PRO polypeptide, or by interfering with vascular endothelial cell activation after binding of a PRO polypeptide to a cellular receptor. All such points of intervention by a PRO polypeptide antagonist shall be considered equivalent for purposes of this invention. The antagonists inhibit the mitogenic, angiogenic, or other biological activity of PRO polypeptides, and thus are useful for the treatment of diseases or disorders characterized by undesirable excessive neovascularization, including by way of example tumors, and especially solid malignant tumors, rheumatoid arthritis, psoriasis, atherosclerosis, diabetic and other retinopathies, retrolental fibroplasia, age-related macular degeneration, neovascular glaucoma, hemangiomas, thyroid hyperplasias (including Grave's disease), corneal and other tissue transplantation, and chronic inflammation. The antagonists also are useful for the treatment of diseases or disorders characterized by undesirable excessive vascular permeability, such as edema associated with brain tumors, ascites associated with malignancies, Meigs' syndrome, lung inflammation, nephrotic syndrome, pericardial effusion (such as that associated with pericarditis), and pleural effusion. In a similar manner, the term "agonist" is used in the broadest sense and includes any molecule that mimics a biological activity of a native PRO polypeptide disclosed herein. Suitable agonist or antagonist molecules specifically include agonist or antagonist antibodies or antibody fragments, fragments, or amino acid sequence variants of native PRO polypeptides, peptides, small organic molecules, etc.

A "small molecule" is defined herein to have a molecular weight below about 500 daltons.

The term "PRO polypeptide receptor" as used herein refers to a cellular receptor for a PRO polypeptide, ordinarily a cell-surface receptor found on vascular endothelial cells, as well as variants thereof that retain the ability to bind a PRO polypeptide.

"Antibodies" (Abs) and "immunoglobulins" (Igs) are glycoproteins having the same structural characteristics. While antibodies exhibit binding specificity to a specific antigen, immunoglobulins include both antibodies and other antibody-like molecules that lack antigen specificity. Polypeptides of the latter kind are, for example, produced at low levels by the lymph system and at increased levels by myelomas. The term "antibody" is used in the broadest sense and specifically covers, without limitation, intact monoclonal antibodies, polyclonal antibodies, multispecific antibodies (e.g., bispecific antibodies) formed from at least two intact antibodies, and antibody fragments, so long as they exhibit the desired biological activity.

"Native antibodies" and "native immunoglobulins" are usually heterotetrameric glycoproteins of about 150,000 daltons, composed of two identical light (L) chains and two identical heavy (H) chains. Each light chain is linked to a heavy chain by one covalent disulfide bond, while the number of disulfide linkages varies among the heavy chains of different immunoglobulin isotypes. Each heavy and light chain also has regularly spaced intrachain disulfide bridges. Each heavy chain has at one end a variable domain (VH) followed by a number of constant domains. Each light chain has a variable domain at one end (VL) and a constant domain at its other end; the constant domain of the light chain is aligned with the first constant domain of the heavy chain, and the light-chain variable domain is aligned with the variable domain of the heavy chain. Particular amino acid residues are believed to form an interface between the light- and heavy-chain variable domains.

The term "variable" refers to the fact that certain portions of the variable domains differ extensively in sequence among antibodies and are used in the binding and specificity of each particular antibody to and for its particular antigen. However, the variability is not evenly distributed throughout the variable domains of antibodies.

It is concentrated in three segments called complementarity-determining regions (CDRs) or hypervariable regions both in the light-chain and the heavy-chain variable domains. The more highly conserved portions of variable domains are called the framework regions (FR). The variable domains of native heavy and light chains each comprise four FR regions, largely adopting a β-sheet configuration, connected by three CDRs, which form loops connecting, and in some cases forming part of, the β-sheet structure. The CDRs in each chain are held together in close proximity by the FR regions and, with the CDRs from the other chain, contribute to the formation of the antigen-binding site of antibodies. See, Kabat et al., *NIH Publ. No.*91–3242, Vol. I, pages 647–669 (1991). The constant domains are not involved directly in binding an antibody to an antigen, but exhibit various effector functions, such as participation of the antibody in antibody-dependent cellular toxicity.

"Antibody fragments" comprise a portion of an intact antibody, preferably the antigen-binding or variable region of the intact antibody. Examples of antibody fragments include Fab, Fab', F(ab')$_2$, and Fv fragments; diabodies; linear antibodies (Zapata et al, *Protein Eng.*, 8(10): 1057–1062 (1995)); single-chain antibody molecules; and multispecific antibodies formed from antibody fragments.

Papain digestion of antibodies produces two identical antigen-binding fragments, called "Fab" fragments, each with a single antigen-binding site, and a residual "Fc" fragment, whose name reflects its ability to crystallize readily. Pepsin treatment yields an F(ab')$_2$ fragment that has two antigen-combining sites and is still capable of cross-linking antigen.

"Fv" is the minimum antibody fragment that contains a complete antigen-recognition and -binding site. This region consists of a dimer of one heavy- and one light-chain variable domain in tight, non-covalent association. It is in this configuration that the three CDRs of each variable domain interact to define an antigen-binding site on the surface of the $V_H$–$V_L$ dimer. Collectively, the six CDRs confer antigen-binding specificity to the antibody. However, even a single variable domain (or half of an Fv comprising only three CDRs specific for an antigen) has the ability to recognize and bind antigen, although at a lower affinity than the entire binding site.

The Fab fragment also contains the constant domain of the light chain and the first constant domain (CH1) of the heavy chain. Fab' fragments differ from Fab fragments by the addition of a few residues at the carboxy terminus of the heavy chain CH1 domain including one or more cysteines from the antibody hinge region. Fab'-SH is the designation herein for Fab' in which the cysteine residue(s) of the constant domains bear a free thiol group. F(ab')$_2$ antibody fragments originally were produced as pairs of Fab' fragments that have hinge cysteines between them. Other chemical couplings of antibody fragments are also known.

The "light chains" of antibodies (immunoglobulins) from any vertebrate species can be assigned to one of two clearly distinct types, called kappa (κ) and lambda (λ), based on the amino acid sequences of their constant domains.

Depending on the amino acid sequence of the constant domain of their heavy chains, immunoglobulins can be assigned to different classes. There are five major classes of immunoglobulins: IgA, IgD, IgE, IgG, and IgM; and several of these may be further divided into subclasses (isotypes), e.g., IgG1, IgG2, IgG3, IgG4, IgA, and IgA2. The heavy-chain constant domains that correspond to the different classes of immunoglobulins are called α, δ, ε, γ, and μ, respectively. The subunit structures and three-dimensional configurations of different classes of immunoglobulins are well known.

The term "monoclonal antibody" as used herein refers to an antibody obtained from a population of substantially homogeneous antibodies, i.e., the individual antibodies comprising the population are identical except for possible naturally-occurring mutations that may be present in minor amounts. Monoclonal antibodies are highly specific, being directed against a single antigenic site. Furthermore, in contrast to conventional (polyclonal) antibody preparations that typically include different antibodies directed against different determinants (epitopes), each monoclonal antibody is directed against a single determinant on the antigen. In addition to their specificity, the monoclonal antibodies are advantageous in that they are synthesized by the hybridoma culture, uncontaminated by other immunoglobulins. The modifier "monoclonal" indicates the character of the antibody as being obtained from a substantially homogeneous population of antibodies, and is not to be construed as requiring production of the antibody by any particular method. For example, the monoclonal antibodies to be used in accordance with the present invention may be made by the hybridoma method first described by Kohler et al., *Nature*, 256: 495 (1975), or may be made by recombinant DNA methods (see, e.g., U.S. Pat. No. 4,816,567). The "monoclonal antibodies" may also be isolated from phage antibody libraries using the techniques described in Clackson et at., *Nature*, 352: 624–628 (1991) and Marks et al., *J. Mol. Biol.*, 222: 581–597 (1991), for example.

The monoclonal antibodies herein specifically include "chimeric" antibodies (immunoglobulins) in which a portion of the heavy and/or light chain is identical with or homologous to corresponding sequences in antibodies derived from a particular species or belonging to a particular antibody class or subclass, while the remainder of the chain(s) is identical with or homologous to corresponding sequences in antibodies derived from another species or belonging to another antibody class or subclass, as well as fragments of such antibodies, so long as they exhibit the desired biological activity. U.S. Pat. No. 4,816,567; Morrison et al., *Proc. Natl. Acad. Sci. USA*, 81: 6851–6855 (1984).

"Humanized" forms of non-human (e.g., murine) antibodies are chimeric immunoglobulins, immunoglobulin chains, or fragments thereof (such as Fv, Fab, Fab', F(ab')$_2$, or other antigen-binding subsequences of antibodies) that contain minimal sequence derived from non-human immunoglobulin. For the most part, humanized antibodies are human immunoglobulins (recipient antibody) in which residues from a CDR of the recipient are replaced by residues from a CDR of a non-human species (donor antibody) such as mouse, rat or rabbit having the desired specificity, affinity, and capacity. In some instances, Fv FR residues of the human immunoglobulin are replaced by corresponding non-human residues. Furthermore, humanized antibodies may comprise residues that are found neither in the recipient antibody nor in the imported CDR or framework sequences.

These modifications are made to further refine and maximize antibody performance. In general, the humanized antibody will comprise substantially all of at least one, and typically two, variable domains, in which all or substantially all of the CDR regions correspond to those of a non-human immunoglobulin and all or substantially all of the FR regions are those of a human immunoglobulin sequence. The humanized antibody preferably also will comprise at least a portion of an immunoglobulin constant region (Fc), typically that of a human immunoglobulin. For further details, see Jones et al., *Nature,* 321: 522–525 (1986); Reichmann et al., *Nature,* 332: 323–329 (1988); and Presta, *Curr. Op. Struct. Biol.,* 2: 593–596 (1992). The humanized antibody includes a PRIMATIZED™ antibody wherein the antigen-binding region of the antibody is derived from an antibody produced by immunizing macaque monkeys with the antigen of interest.

"Single-chain Fv" or "sFv" antibody fragments comprise the $V_H$ and $V_L$ domains of an antibody, wherein these domains are present in a single polypeptide chain. Preferably, the Fv polypeptide further comprises a polypeptide linker between the $V_H$ and $V_L$ domains that enables the sFv to form the desired structure for antigen binding. For a review of sFv see, Pluckthun in *The Pharmacology of Monoclonal Antibodies,* Vol.113, Rosenburg and Moore, eds. (Springer-Verlag: New York, 1994), pp. 269–315.

The term "diabodies" refers to small antibody fragments with two antigen-binding sites, which fragments comprise a heavy-chain variable domain ($V_H$) connected to a light-chain variable domain ($V_L$) in the same polypeptide chain ($V_H$-$V_L$). By using a linker that is too short to allow pairing between the two domains on the same chain, the domains are forced to pair with the complementary domains of another chain and create two antigen-binding sites. Diabodies are described more fully in, for example, EP 404,097; WO 93/11161; and Hollinger et al., *Proc. Natl. Acad. Sci. USA,* 90: 6444–6448 (1993).

An "isolated" antibody is one that has been identified and separated and/or recovered from a component of its natural environment, Contaminant components of its natural environment are materials that would interfere with diagnostic or therapeutic uses for the antibody, and may include enzymes, hormones, and other proteinaceous or nonproteinaceous solutes. In preferred embodiments, the antibody will be purified (1) to greater than 95% by weight of antibody as determined by the Lowry method, and most preferably more than 99% by weight, (2) to a degree sufficient to obtain at least 15 residues of N-terminal or internal amino acid sequence by use of a spinning cup sequenator, or (3) to homogeneity by SDS-PAGE under reducing or nonreducing conditions using Coomassie blue or, preferably, silver stain. Isolated antibody includes the antibody in situ within recombinant cells, since at least one component of the antibody's natural environment will not be present. Ordinarily, however, isolated antibody will be prepared by at least one purification step.

An antibody that "specifically binds to" or is "specific for" a particular polypeptide or an epitope on a particular polypeptide is one that binds to that particular polypeptide or epitope on a particular polypeptide without substantially binding to any other polypeptide or polypeptide epitope.

The word "label" when used herein refers to a detectable compound or other composition that is conjugated directly or indirectly to the antibody so as to generate a "labeled" antibody. The label may be detectable by itself (e.g., radioisotope labels or fluorescent labels) or, in the case of an enzymatic label, may catalyze chemical alteration of a substrate compound or composition that is detectable. Radionuclides that can serve as detectable labels include, for example, I-131, I-123, I-125, Y-90, Re-188, At-211, Cu-67, Bi-212, and Pd-109. The label may also be anon-detectable entity such as a toxin.

By "solid phase" is meant a non-aqueous matrix to which an antibody of the present invention can adhere. Examples of solid phases encompassed herein include those formed partially or entirely of glass (e.g., controlled pore glass), polysaccharides (e.g., agarose), polyacrylamides, polystyrene, polyvinyl alcohol and silicones. In certain embodiments, depending on the context, the solid phase can comprise the well of an assay plate; in others it is a purification column (e.g., an affinity chromatography column). This term also includes a discontinuous solid phase of discrete particles, such as those described in U.S. Pat. No. 4,275,149.

A "liposome" is a small vesicle composed of various types of lipids, phospholipids and/or surfactant that is useful for delivery of a drug (such as the PRO polypeptide or antibodies thereto disclosed herein) to a mammal. The components of the liposome are commonly arranged in a bilayer formation, similar to the lipid arrangement of biological membranes.

As used herein, the term "immunoadhesin" designates antibody-like molecules that combine the binding specificity of a heterologous protein (an "adhesin") with the effector functions of immunoglobulin constant domains. Structurally, the immunoadhesins comprise a fusion of an amino acid sequence with the desired binding specificity that is other than the antigen recognition and binding site of an antibody (i.e., is "heterologous"), and an immunoglobulin constant domain sequence. The adhesin part of an immunoadhesin molecule typically is a contiguous amino acid sequence comprising at least the binding site of a receptor or a ligand. The immunoglobulin constant domain sequence in the immunoadhesin may be obtained from any immunoglobulin, such as IgG-1, IgG-2, IgG-3, or IgG-4 subtypes, IgA (including IgA-1 and IgA-2), IgE, IgD, or IgM.

As shown below, Table 1 provides the complete source code for the ALIGN-2 sequence comparison computer program. This source code may be routinely compiled for use on a UNIX operating system to provide the ALIGN-2 sequence comparison computer program.

In addition, Tables 2–5 show hypothetical exemplifications for using the below described method to determine % amino acid sequence identity (Tables 2–3) and % nucleic acid sequence identity (Tables 4–5) using the ALIGN-2 sequence comparison computer program, wherein "PRO" represents the amino acid sequence of a hypothetical PRO polypeptide of interest, "Comparison Protein" represents the amino acid sequence of a polypeptide against which the "PRO" polypeptide of interest is being compared, "PRO-DNA" represents a hypothetical PRO-encoding nucleic acid sequence of interest, "Comparison DNA" represents the nucleotide sequence of a nucleic acid molecule against which the "PRO-DNA" nucleic acid molecule of interest is being compared, "X", "Y", and "Z" each represent different hypothetical amino acid residues and "N", "L" and "V" each represent different hypothetical nucleotides.

Table 1

```
/*
 *
 * C-C increased from 12 to 15
 * Z is average of EQ
 * B is average of ND
 * match with stop is _M; stop-stop = 0; J (joker) match = 0
 */
define  _M       -8          /* value of a match with a stop */ int      _day[26][26] = {
/*        A B C D E F G H I J K L M N O P Q R S T U V W X Y Z */
/* A */  { 2, 0,-2, 0, 0,-4, 1,-1,-1, 0,-1,-2,-1, 0,_M, 1, 0,-2, 1, 1, 0, 0,-6, 0,-3, 0},
/* B */  { 0, 3,-4, 3, 2,-5, 0, 1,-2, 0, 0,-3,-2, 2,_M,-1, 1, 0, 0, 0, 0,-2,-5, 0,-3, 1},
/* C */  {-2,-4,15,-5,-5,-4,-3,-3,-2, 0,-5,-6,-5,-4,_M,-3,-5,-4, 0,-2, 0,-2,-8, 0, 0,-5},
/* D */  { 0, 3,-5, 4, 3,-6, 1, 1,-2, 0, 0,-4,-3, 2,_M,-1, 2,-1, 0, 0, 0,-2,-7, 0,-4, 2},
/* E */  { 0, 2,-5, 3, 4,-5, 0, 1,-2, 0, 0,-3,-2, 1,_M,-1, 2,-1, 0, 0, 0,-2,-7, 0,-4, 3},
/* F */  {-4,-5,-4,-6,-5, 9,-5,-2, 1, 0,-5, 2, 0,-4,_M,-5,-5,-4,-3,-3, 0,-1, 0, 0, 7,-5},
/* G */  { 1, 0,-3, 1, 0,-5, 5,-2,-3, 0,-2,-4,-3, 0,_M,-1,-1,-3, 1, 0, 0,-1,-7, 0,-5, 0},
/* H */  {-1, 1,-3, 1, 1,-2,-2, 6,-2, 0, 0,-2,-2, 2,_M, 0, 3, 2,-1,-1, 0,-2,-3, 0, 0, 2},
/* I */  {-1,-2,-2,-2,-2, 1,-3,-2, 5, 0,-2, 2, 2,-2,_M,-2,-2,-2,-1, 0, 0, 4,-5, 0,-1,-2},
/* J */  { 0, 0, 0, 0, 0, 0, 0, 0, 0, 0, 0, 0, 0, 0,_M, 0, 0, 0, 0, 0, 0, 0, 0, 0, 0, 0},
/* K */  {-1, 0,-5, 0, 0,-5,-2, 0,-2, 0, 5,-3, 0, 1,_M,-1, 1, 3, 0, 0, 0,-2,-3, 0,-4, 0},
/* L */  {-2,-3,-6,-4,-3, 2,-4,-2, 2, 0,-3, 6, 4,-3,_M,-3,-2,-3,-3,-1, 0, 2,-2, 0,-1,-2},
/* M */  {-1,-2,-5,-3,-2, 0,-3,-2, 2, 0, 0, 4, 6,-2,_M,-2,-1, 0,-2,-1, 0, 2,-4, 0,-2,-1},
/* N */  { 0, 2,-4, 2, 1,-4, 0, 2,-2, 0, 1,-3,-2, 2,_M,-1, 1, 0, 1, 0, 0,-2,-4, 0,-2, 1},
/* O */  {_M,_M,_M,_M,_M,_M,_M,_M,_M,_M,_M,_M,_M,_M, 0,_M,_M,_M,_M,_M,_M,_M,_M,_M,_M,_M},
/* P */  { 1,-1,-3,-1,-1,-5,-1, 0,-2, 0,-1,-3,-2,-1,_M, 6, 0, 0, 1, 0, 0,-1,-6, 0,-5, 0},
/* Q */  { 0, 1,-5, 2, 2,-5,-1, 3,-2, 0, 1,-2,-1, 1,_M, 0, 4, 1,-1,-1, 0,-2,-5, 0,-4, 3},
/* R */  {-2, 0,-4,-1,-1,-4,-3, 2,-2, 0, 3,-3, 0, 0,_M, 0, 1, 6, 0,-1, 0,-2, 2, 0,-4, 0},
/* S */  { 1, 0, 0, 0, 0,-3, 1,-1,-1, 0, 0,-3,-2, 1,_M, 1,-1, 0, 2, 1, 0,-1,-2, 0,-3, 0},
/* T */  { 1, 0,-2, 0, 0,-3, 0,-1, 0, 0, 0,-1,-1, 0,_M, 0,-1,-1, 1, 3, 0, 0,-5, 0,-3, 0},
/* U */  { 0, 0, 0, 0, 0, 0, 0, 0, 0, 0, 0, 0, 0, 0,_M, 0, 0, 0, 0, 0, 0, 0, 0, 0, 0, 0},
/* V */  { 0,-2,-2,-2,-2,-1,-1,-2, 4, 0,-2, 2, 2,-2,_M,-1,-2,-2,-1, 0, 0, 4,-6, 0,-2,-2},
/* W */  {-6,-5,-8,-7,-7, 0,-7,-3,-5, 0,-3,-2,-4,-4,_M,-6,-5, 2,-2,-5, 0,-6,17, 0, 0,-6},
/* X */  { 0, 0, 0, 0, 0, 0, 0, 0, 0, 0, 0, 0, 0, 0,_M, 0, 0, 0, 0, 0, 0, 0, 0, 0, 0, 0},
/* Y */  {-3,-3, 0,-4,-4, 7,-5, 0,-1, 0,-4,-1,-2,-2,_M,-5,-4,-4,-3,-3, 0,-2, 0, 0,10,-4},
/* Z */  { 0, 1,-5, 2, 3,-5, 0, 2,-2, 0, 0,-2,-1, 1,_M, 0, 3, 0, 0, 0, 0,-2,-6, 0,-4, 4}
};
```

Table 1 (cont')

```c
/*
*/
#include <stdio.h>
include <ctype.h> define MAXJMP  16    /* max jumps in a diag */
define MAXGAP  24    /* don't continue to penalize gaps larger than this */
#define JMPS    1024  /* max jmps in an path */
define MX      4     /* save if there's at least MX-1 bases since last jmp */ define DMAT    3     /* value of matching bases */
define DMIS    0     /* penalty for mismatched bases */
#define DINS0   8     /* penalty for a gap */
#define DINS1   1     /* penalty per base */
#define PINS0   8     /* penalty for a gap */
define PINS1   4     /* penalty per residue */ struct jmp {
        short          n[MAXJMP];    /* size of jmp (neg for dely) */
        unsigned short x[MAXJMP];    /* base no. of jmp in seq x */
};                                   /* limits seq to 2^16 -1 */ struct diag {
        int        score;     /* score at last jmp */
        long       offset;    /* offset of prev block */
        short      ijmp;      /* current jmp index */
        struct jmp jp;        /* list of jmps */
};

struct path {
        int   spc;        /* number of leading spaces */
        short n[JMPS];    /* size of jmp (gap) */
        int   x[JMPS];    /* loc of jmp (last elem before gap) */
};

char        *ofile;       /* output file name */
char        *namex[2];    /* seq names: getseqs( ) */
char        *prog;        /* prog name for err msgs */
char        *seqx[2];     /* seqs: getseqs( ) */
int         dmax;         /* best diag: nw( ) */
int         dmax0;        /* final diag */
int         dna;          /* set if dna: main( ) */
int         endgaps;      /* set if penalizing end gaps */
int         gapx, gapy;   /* total gaps in seqs */
int         len0, len1;   /* seq lens */
int         ngapx, ngapy; /* total size of gaps */
int         smax;         /* max score: nw( ) */
int         *xbm;         /* bitmap for matching */
long        offset;       /* current offset in jmp file */
struct diag *dx;          /* holds diagonals */
struct path pp[2];        /* holds path for seqs */ char        *calloc( ), *malloc( ), *index( ), *strcpy( );
char        *getseq( ), *g_calloc( );
```

Table 1 (cont')

```
/* Needleman-Wunsch alignment program
 *
 * usage: progs file1 file2
 *    where file1 and file2 are two dna or two protein sequences.
 *    The sequences can be in upper- or lower-case an may contain ambiguity
 *    Any lines beginning with ';', '>' or '<' are ignored
 *    Max file length is 65535 (limited by unsigned short x in the jmp struct)
 *    A sequence with 1/3 or more of its elements ACGTU is assumed to be DNA
 *    Output is in the file "align.out"
 *
 * The program may create a tmp file in /tmp to hold info about traceback.
 * Original version developed under BSD 4.3 on a vax 8650
 */
include "nw.h"
#include "day.h"

static  _dbval[26] = {
        1,14,2,13,0,0,4,11,0,0,12,0,3,15,0,0,0,5,6,8,8,7,9,0,10,0
};

static  _pbval[26] = {
        1, 2|(1<<('D'-'A'))|(1<<('N'-'A')), 4, 8, 16, 32, 64,
        128, 256, 0xFFFFFFF, 1<<10, 1<<11, 1<<12, 1<<13, 1<<14,
        1<<15, 1<<16, 1<<17, 1<<18, 1<<19, 1<<20, 1<<21, 1<<22,
        1<<23, 1<<24, 1<<25|(1<<('E'-'A'))|(1<<('Q'-'A'))
};

main(ac, av)                                                                    main
        int     ac;
        char    *av[];
{
        prog = av[0];
        if (ac != 3) {
                fprintf(stderr,"usage: %s file1 file2\n", prog);
                fprintf(stderr,"where file1 and file2 are two dna or two protein sequences.\n");
                fprintf(stderr,"The sequences can be in upper- or lower-case\n");
                fprintf(stderr,"Any lines beginning with ';' or '<' are ignored\n");
                fprintf(stderr,"Output is in the file \"align.out\"\n");
                exit(1);
        }
        namex[0] = av[1];
        namex[1] = av[2];
        seqx[0] = getseq(namex[0], &len0);
        seqx[1] = getseq(namex[1], &len1);
        xbm = (dna)? _dbval : _pbval;

endgaps = 0;                    /* 1 to penalize endgaps */
        ofile = "align.out";            /* output file */ nw( );          /* fill in the matrix, get the possible jmps */
        readjmps( );    /* get the actual jmps */
        print( );       /* print stats, alignment */ cleanup(0);     /* unlink any tmp files */
}
```

Table 1 (cont')

```
/* do the alignment, return best score: main( )
 * dna: values in Fitch and Smith, PNAS, 80, 1382-1386, 1983
 * pro: PAM 250 values
 * When scores are equal, we prefer mismatches to any gap, prefer
 * a new gap to extending an ongoing gap, and prefer a gap in seqx
 * to a gap in seq y.
 */
nw( )                                                                                        nw
{
        char         *px, *py;              /* seqs and ptrs */
        int          *ndely, *dely;         /* keep track of dely */
        int          ndelx, delx;           /* keep track of delx */
        int          *tmp;                  /* for swapping row0, row1 */
        int          mis;                   /* score for each type */
        int          ins0, ins1;            /* insertion penalties */
        register     id;                    /* diagonal index */
        register     ij;                    /* jmp index */
        register     *col0, *col1;          /* score for curr, last row */
        register     xx, yy;                /* index into seqs */ dx = (struct diag *)g_calloc("to get diags", len0+len1+1, sizeof(struct diag));

ndely = (int *)g_calloc("to get ndely", len1+1, sizeof(int));
        dely  = (int *)g_calloc("to get dely",  len1+1, sizeof(int));
        col0  = (int *)g_calloc("to get col0",  len1+1, sizeof(int));
        col1  = (int *)g_calloc("to get col1",  len1+1, sizeof(int));
        ins0  = (dna)? DINS0 : PINS0;
        ins1  = (dna)? DINS1 : PINS1;

smax = -10000;
        if (endgaps) {
                for (col0[0] = dely[0] = -ins0, yy = 1; yy <= len1; yy++) {
                        col0[yy] = dely[yy] = col0[yy-1] - ins1;
                        ndely[yy] = yy;
                }
                col0[0] = 0;       /* Waterman Bull Math Biol 84 */
        }
        else
                for (yy = 1; yy <= len1; yy++)
                        dely[yy] = -ins0;

/* fill in match matrix
         */
        for (px = seqx[0], xx = 1; xx <= len0; px++, xx++) {
                /* initialize first entry in col
                 */
                if (endgaps) {
                        if (xx == 1)
                                col1[0] = delx = -(ins0+ins1);
                        else
                                col1[0] = delx = col0[0] - ins1;
                        ndelx = xx;
                }
                else {
                        col1[0] = 0;
                        delx = -ins0;
                        ndelx = 0;
                }
```

Table 1 (cont')

...nw

```
for (py = seqx[1], yy = 1; yy <= len1; py++, yy++) {
        mis = col0[yy-1];
        if (dna)
                mis += (xbm[*px-'A']&xbm[*py-'A'])? DMAT : DMIS;
        else
                mis += _day[*px-'A'][*py-'A'];

/* update penalty for del in x seq;
         * favor new del over ongong del
         * ignore MAXGAP if weighting endgaps
         */
        if (endgaps || ndely[yy] < MAXGAP) {
                if (col0[yy] - ins0 >= dely[yy]) {
                        dely[yy] = col0[yy] - (ins0+ins1);
                        ndely[yy] = 1;
                } else {
                        dely[yy] -= ins1;
                        ndely[yy]++;
                }
        } else {
                if (col0[yy] - (ins0+ins1) >= dely[yy]) {
                        dely[yy] = col0[yy] - (ins0+ins1);
                        ndely[yy] = 1;
                } else
                        ndely[yy]++;
        }

/* update penalty for del in y seq;
         * favor new del over ongong del
         */
        if (endgaps || ndelx < MAXGAP) {
                if (col1[yy-1] - ins0 >= delx) {
                        delx = col1[yy-1] - (ins0+ins1);
                        ndelx = 1;
                } else {
                        delx -= ins1;
                        ndelx++;
                }
        } else {
                if (col1[yy-1] - (ins0+ins1) >= delx) {
                        delx = col1[yy-1] - (ins0+ins1);
                        ndelx = 1;
                } else
                        ndelx++;
        }

/* pick the maximum score; we're favoring
         * mis over any del and delx over dely
         */
```

Table 1 (cont')

...nw

```
                    id = xx - yy + len1 - 1;
                    if (mis > = delx && mis > = dely[yy])
                              col1[yy] = mis;
                    else if (delx > = dely[yy]) {
                              col1[yy] = delx;
                              ij = dx[id].ijmp;
                              if (dx[id].jp.n[0] && (!dna || (ndelx > = MAXJMP
                              && xx > dx[id].jp.x[ij]+MX) || mis > dx[id].score+DINS0)) {
                                        dx[id].ijmp++;
                                        if (++ij > = MAXJMP) {
                                                  writejmps(id);
                                                  ij = dx[id].ijmp = 0;
                                                  dx[id].offset = offset;
                                                  offset += sizeof(struct jmp) + sizeof(offset);
                                        }
                              }
                              dx[id].jp.n[ij] = ndelx;
                              dx[id].jp.x[ij] = xx;
                              dx[id].score = delx;
                    }
                    else {
                              col1[yy] = dely[yy];
                              ij = dx[id].ijmp;
          if (dx[id].jp.n[0] && (!dna || (ndely[yy] > = MAXJMP
                              && xx > dx[id].jp.x[ij]+MX) || mis > dx[id].score+DINS0)) {
                                        dx[id].ijmp++;
                                        if (++ij > = MAXJMP) {
                                                  writejmps(id);
                                                  ij = dx[id].ijmp = 0;
                                                  dx[id].offset = offset;
                                                  offset += sizeof(struct jmp) + sizeof(offset);
                                        }
                              }
                              dx[id].jp.n[ij] = -ndely[yy];
                              dx[id].jp.x[ij] = xx;
                              dx[id].score = dely[yy];
                    }
                    if (xx == len0 && yy < len1) {
                              /* last col
                              */
                              if (endgaps)
                                        col1[yy] -= ins0+ins1*(len1-yy);
                              if (col1[yy] > smax) {
                                        smax = col1[yy];
                                        dmax = id;
                              }
                    }
          }
          if (endgaps && xx < len0)
                    col1[yy-1] -= ins0+ins1*(len0-xx);
          if (col1[yy-1] > smax) {
                    smax = col1[yy-1];
                    dmax = id;
          }
          tmp = col0; col0 = col1; col1 = tmp;
}
(void) free((char *)ndely);
(void) free((char *)dely);
(void) free((char *)col0);
(void) free((char *)col1);                                       }
```

Table 1 (cont')

```
/*
 *
 * print( ) -- only routine visible outside this module
 *
 * static:
 * getmat( ) -- trace back best path, count matches: print( )
 * pr_align( ) -- print alignment of described in array p[]: print( )
 * dumpblock( ) -- dump a block of lines with numbers, stars: pr_align( )
 * nums( ) -- put out a number line: dumpblock( )
 * putline( ) -- put out a line (name, [num], seq, [num]): dumpblock( )
 * stars( ) - -put a line of stars: dumpblock( )
 * stripname( ) -- strip any path and prefix from a seqname
 */ include "nw.h"

define SPC     3
#define P_LINE  256   /* maximum output line */
define P_SPC   3     /* space between name or num and seq */ extern    _day[26][26];
int       olen;       /* set output line length */
FILE      *fx;        /* output file */ print( )                                                                print
{
        int     lx, ly, firstgap, lastgap;      /* overlap */ if ((fx = fopen(ofile, "w")) == 0) {
                fprintf(stderr,"%s: can't write %s\n", prog, ofile);
                cleanup(1);
        }
        fprintf(fx, "<first sequence: %s (length = %d)\n", namex[0], len0);
        fprintf(fx, "<second sequence: %s (length = %d)\n", namex[1], len1);
        olen = 60;
        lx = len0;
        ly = len1;
        firstgap = lastgap = 0;
        if (dmax < len1 - 1) {          /* leading gap in x */
                pp[0].spc = firstgap = len1 - dmax - 1;
                ly -= pp[0].spc;
        }
        else if (dmax > len1 - 1) {     /* leading gap in y */
                pp[1].spc = firstgap = dmax - (len1 - 1);
                lx -= pp[1].spc;
        }
        if (dmax0 < len0 - 1) {         /* trailing gap in x */
                lastgap = len0 - dmax0 -1;
                lx -= lastgap;
        }
        else if (dmax0 > len0 - 1) {    /* trailing gap in y */
                lastgap = dmax0 - (len0 - 1);
                ly -= lastgap;
        }
        getmat(lx, ly, firstgap, lastgap);
        pr_align( );
}
```

Table 1 (cont')

getmat

```
/*
 * trace back the best path, count matches
 */
static
getmat(lx, ly, firstgap, lastgap)
        int     lx, ly;                 /* "core" (minus endgaps) */
        int     firstgap, lastgap;      /* leading trailing overlap */
{
        int             nm, i0, i1, siz0, siz1;
        char            outx[32];
        double          pct;
        register        n0, n1;
        register char   *p0, *p1;

/* get total matches, score
         */
        i0 = i1 = siz0 = siz1 = 0;
        p0 = seqx[0] + pp[1].spc;
        p1 = seqx[1] + pp[0].spc;
        n0 = pp[1].spc + 1;
        n1 = pp[0].spc + 1;

nm = 0;
        while ( *p0 && *p1 ) {
                if (siz0) {
                        p1++;
                        n1++;
                        siz0--;
                }
                else if (siz1) {
                        p0++;
                        n0++;
                        siz1--;
                }
                else {
                        if (xbm[*p0-'A']&xbm[*p1-'A'])
                                nm++;
                        if (n0++ == pp[0].x[i0])
                                siz0 = pp[0].n[i0++];
                        if (n1++ == pp[1].x[i1])
                                siz1 = pp[1].n[i1++];
                        p0++;
                        p1++;
                }
        }

/* pct homology:
         * if penalizing endgaps, base is the shorter seq
         * else, knock off overhangs and take shorter core
         */
        if (endgaps)
                lx = (len0 < len1)? len0 : len1;
        else
                lx = (lx < ly)? lx : ly;
        pct = 100.*(double)nm/(double)lx;
        fprintf(fx, "\n");
        fprintf(fx, " < %d match%s in an overlap of %d: %.2f percent similarity\n",
                nm, (nm == 1)? "" : "es", lx, pct);
```

Table 1 (cont')

```
        fprintf(fx, "<gaps in first sequence: %d", gapx);                                    ...getmat
        if (gapx) {
                (void) sprintf(outx, " (%d %s%s)",
                        ngapx, (dna)? "base":"residue", (ngapx == 1)? "":"s");
                fprintf(fx,"%s", outx);
        } fprintf(fx, ", gaps in second sequence: %d", gapy);
        if (gapy) {
                (void) sprintf(outx, " (%d %s%s)",
                        ngapy, (dna)? "base":"residue", (ngapy == 1)? "":"s");
                fprintf(fx,"%s", outx);
        }
        if (dna)
                fprintf(fx,
                "\n<score: %d (match = %d, mismatch = %d, gap penalty = %d + %d per base)\n",
                smax, DMAT, DMIS, DINS0, DINS1);
        else
                fprintf(fx,
                "\n<score: %d (Dayhoff PAM 250 matrix, gap penalty = %d + %d per residue)\n",
                smax, PINS0, PINS1);
        if (endgaps)
                fprintf(fx,
                " <endgaps penalized. left endgap: %d %s%s, right endgap: %d %s%s\n",
                firstgap, (dna)? "base" : "residue", (firstgap == 1)? "" : "s",
                lastgap, (dna)? "base" : "residue", (lastgap == 1)? "" : "s");
        else
                fprintf(fx, " <endgaps not penalized\n");
} static          nm;              /* matches in core -- for checking */
static          lmax;            /* lengths of stripped file names */
static          ij[2];           /* jmp index for a path */
static          nc[2];           /* number at start of current line */
static          ni[2];           /* current elem number -- for gapping */
static          siz[2];
static char     *ps[2];          /* ptr to current element */
static char     *po[2];          /* ptr to next output char slot */
static char     out[2][P_LINE];  /* output line */
static char     star[P_LINE];    /* set by stars() */

/*
* print alignment of described in struct path pp[]
*/
static
pr_align()                                                                                   pr_align
{
        int     nn;      /* char count */
        int     more;
        register i;

for (i = 0, lmax = 0; i < 2; i++) {
                nn = stripname(namex[i]);
                if (nn > lmax)
                        lmax = nn;

nc[i] = 1;
                ni[i] = 1;
                siz[i] = ij[i] = 0;
                ps[i] = seqx[i];
                po[i] = out[i];                          }
```

Table 1 (cont')

```
    for (nn = nm = 0, more = 1; more; ) {                                    ...pr_align
        for (i = more = 0; i < 2; i++) {
            /*
             * do we have more of this sequence?
             */
            if (!*ps[i])
                continue;

more++;

if (pp[i].spc) {        /* leading space */
                *po[i]++ = ' ';
                pp[i].spc--;
            }
            else if (siz[i]) {      /* in a gap */
                *po[i]++ = '-';
                siz[i]--;
            }
            else {                  /* we're putting a seq element
                                     */
                *po[i] = *ps[i];
                if (islower(*ps[i]))
                    *ps[i] = toupper(*ps[i]);
                po[i]++;
                ps[i]++;

/*
                 * are we at next gap for this seq?
                 */
                if (ni[i] == pp[i].x[ij[i]]) {
                    /*
                     * we need to merge all gaps
                     * at this location
                     */
                    siz[i] = pp[i].n[ij[i]++];
                    while (ni[i] == pp[i].x[ij[i]])
                        siz[i] += pp[i].n[ij[i]++];
                }
                ni[i]++;
            }
        }
        if (++nn == olen || !more && nn) {
            dumpblock( );
            for (i = 0; i < 2; i++)
                po[i] = out[i];
            nn = 0;
        }
    }
}
/*
 * dump a block of lines, including numbers, stars: pr_align( )
 */
static
dumpblock( )                                                                 dumpblock
{
    register i;

for (i = 0; i < 2; i++)
        *po[i]-- = '\0';
```

Table 1 (cont')

...dumpblock

```
        (void) putc('\n', fx);
        for (i = 0; i < 2; i++) {
                if (*out[i] && (*out[i] != ' ' || *(po[i]) != ' ')) {
                        if (i == 0)
                                nums(i);
                        if (i == 0 && *out[1])
                                stars( );
                        putline(i);
                        if (i == 0 && *out[1])
                                fprintf(fx, star);
                        if (i == 1)
                                nums(i);
                }
        }
}

/*
* put out a number line: dumpblock( )
*/
static
nums(ix)
        int     ix;     /* index in out[] holding seq line */
{
        char            nline[P_LINE];
        register        i, j;
        register char   *pn, *px, *py;

for (pn = nline, i = 0; i < lmax+P_SPC; i++, pn++)
                *pn = ' ';
        for (i = nc[ix], py = out[ix]; *py; py++, pn++) {
                if (*py == ' ' || *py == '-')
                        *pn = ' ';
                else {
                        if (i%10 == 0 || (i == 1 && nc[ix] != 1)) {
                                j = (i < 0)? -i : i;
                                for (px = pn; j; j /= 10, px--)
                                        *px = j%10 + '0';
                                if (i < 0)
                                        *px = '-';
                        }
                        else
                                *pn = ' ';
                        i++;
                }
        }
        *pn = '\0';
        nc[ix] = i;
        for (pn = nline; *pn; pn++)
                (void) putc(*pn, fx);
        (void) putc('\n', fx);
}

/*
* put out a line (name, [num], seq, [num]): dumpblock( )
*/
static
putline(ix)
        int     ix;                             {
``` nums putline

Table 1 (cont')

...putline

```
        int         i;
        register char   *px;

for (px = namex[ix], i = 0; *px && *px != ':'; px++, i++)
                (void) putc(*px, fx);
        for (; i < lmax+P_SPC; i++)
                (void) putc(' ', fx);

/* these count from 1:
         * ni[] is current element (from 1)
         * nc[] is number at start of current line
         */
        for (px = out[ix]; *px; px++)
                (void) putc(*px&0x7F, fx);
        (void) putc('\n', fx);
}

/*
 * put a line of stars (seqs always in out[0], out[1]): dumpblock( )
 */
static
stars( )
{
        int         i;
        register char   *p0, *p1, cx, *px;

if (!*out[0] || (*out[0] == ' ' && *(po[0]) == ' ') ||
            !*out[1] || (*out[1] == ' ' && *(po[1]) == ' '))
                return;
        px = star;
        for (i = lmax+P_SPC; i; i--)
                *px++ = ' ';

for (p0 = out[0], p1 = out[1]; *p0 && *p1; p0++, p1++) {
                if (isalpha(*p0) && isalpha(*p1)) { if (xbm[*p0-'A']&xbm[*p1-'A']) {
                                cx = '*';
                                nm++;
                        }
                        else if (!dna && _day[*p0-'A'][*p1-'A'] > 0)
                                cx = '.';
                        else
                                cx = ' ';
                }
                else
                        cx = ' ';
                *px++ = cx;
        }
        *px++ = '\n';
        *px = '\0';
}
``` stars

Table 1 (cont')

```
/*
 * strip path or prefix from pn, return len: pr_align( )
 */
static
stripname(pn)                                                                    stripname
        char     *pn;      /* file name (may be path) */
{
        register char     *px, *py;

py - 0;
        for (px = pn; *px; px++)
                if (*px == '/')
                        py = px + 1;
        if (py)
                (void) strcpy(pn, py);
        return(strlen(pn));

}
```

Table 1 (cont')

```
/*
 * cleanup( ) -- cleanup any tmp file
 * getseq( ) -- read in seq, set dna, len, maxlen
 * g_calloc( ) -- calloc( ) with error checkin
 * readjmps( ) -- get the good jmps, from tmp file if necessary
 * writejmps( ) -- write a filled array of jmps to a tmp file: nw( )
 */
include "nw.h"
include <sys/file.h> char      *jname = "/tmp/homgXXXXXX";          /* tmp file for jmps */
FILE      *fj;

int       cleanup( );                          /* cleanup tmp file */
long      lseek( );

/*
 * remove any tmp file if we blow
 */
cleanup(i)                                                                  cleanup
          int       i;
{
          if (fj)
                    (void) unlink(jname);
          exit(i);
}

/*
 * read, return ptr to seq, set dna, len, maxlen
 * skip lines starting with ';', '<', or '>'
 * seq in upper or lower case
 */
char      *
getseq(file, len)                                                           getseq
          char      *file;     /* file name */
          int       *len;      /* seq len */
{
          char           line[1024], *pseq;
          register char  *px, *py;
          int            natgc, tlen;
          FILE           *fp;

if ((fp = fopen(file,"r")) == 0) {
                    fprintf(stderr,"%s: can't read %s\n", prog, file);
                    exit(1);
          }
          tlen = natgc = 0;
          while (fgets(line, 1024, fp)) {
                    if (*line == ';' || *line == '<' || *line == '>')
                              continue;
                    for (px = line; *px != '\n'; px++)
                              if (isupper(*px) || islower(*px))
                                        tlen++;
          }
          if ((pseq = malloc((unsigned)(tlen+6))) == 0) {
                    fprintf(stderr,"%s: malloc( ) failed to get %d bytes for %s\n", prog, tlen+6, file);
                    exit(1);
          }
          pseq[0] = pseq[1] = pseq[2] = pseq[3] = '\0';
```

Table 1 (cont')

...getseq

```
        py = pseq + 4;
        *len = tlen;
        rewind(fp);

while (fgets(line, 1024, fp)) {
                if (*line == ';' || *line == '<' || *line == '>')
                        continue;
                for (px = line; *px != '\n'; px++) {
                        if (isupper(*px))
                                *py++ = *px;
                        else if (islower(*px))
                                *py++ = toupper(*px);
                        if (index("ATGCU",*(py-1)))
                                natgc++;
                }
        }
        *py++ = '\0';
        *py = '\0';
        (void) fclose(fp);
        dna = natgc > (tlen/3);
        return(pseq+4);
} char    *
g_calloc(msg, nx, sz)
        char    *msg;           /* program, calling routine */
        int     nx, sz;         /* number and size of elements */
{
        char            *px, *calloc( );

if ((px = calloc((unsigned)nx, (unsigned)sz)) == 0) {
                if (*msg) {
                        fprintf(stderr, "%s: g_calloc( ) failed %s (n=%d, sz=%d)\n", prog, msg, nx, sz);
                        exit(1);
                }
        }
        return(px);
}

/*
 * get final jmps from dx[] or tmp file, set pp[], reset dmax: main( )
 */
readjmps( )
{
        int             fd = -1;
        int             siz, i0, i1;
        register i, j, xx;

if (fj) {
                (void) fclose(fj);
                if ((fd = open(jname, O_RDONLY, 0)) < 0) {
                        fprintf(stderr, "%s: can't open( ) %s\n", prog, jname);
                        cleanup(1);
                }
        }
        for (i = i0 = i1 = 0, dmax0 = dmax, xx = len0; ; i++) {
                while (1) {
                        for (j = dx[dmax].ijmp; j >= 0 && dx[dmax].jp.x[j] >= xx; j--)
                                ;
``` g_calloc readjmps

Table 1 (cont')

...readjmps

```
                if (j < 0 && dx[dmax].offset && fj) {
                    (void) lseek(fd, dx[dmax].offset, 0);
                    (void) read(fd, (char *)&dx[dmax].jp, sizeof(struct jmp));
                    (void) read(fd, (char *)&dx[dmax].offset, sizeof(dx[dmax].offset));
                    dx[dmax].ijmp = MAXJMP-1;
                }
                else
                    break;
            }
            if (i >= JMPS) {
                fprintf(stderr, "%s: too many gaps in alignment\n", prog);
                cleanup(1);
            }
            if (j >= 0) {
                siz = dx[dmax].jp.n[j];
                xx = dx[dmax].jp.x[j];
                dmax += siz;
                if (siz < 0) {                  /* gap in second seq */
                    pp[1].n[i1] = -siz;
                    xx += siz;
                    /* id = xx - yy + len1 - 1
                     */
                    pp[1].x[i1] = xx - dmax + len1 - 1;
                    gapy++;
                    ngapy -= siz;
/* ignore MAXGAP when doing endgaps */
                    siz = (-siz < MAXGAP || endgaps)? -siz : MAXGAP;
                    i1++;
                }
                else if (siz > 0) {    /* gap in first seq */
                    pp[0].n[i0] = siz;
                    pp[0].x[i0] = xx;
                    gapx++;
                    ngapx += siz;
/* ignore MAXGAP when doing endgaps */
                    siz = (siz < MAXGAP || endgaps)? siz : MAXGAP;
                    i0++;
                }
            }
            else
                break;
        }

/* reverse the order of jmps
         */
        for (j = 0, i0--; j < i0; j++, i0--) {
            i = pp[0].n[j]; pp[0].n[j] = pp[0].n[i0]; pp[0].n[i0] = i;
            i = pp[0].x[j]; pp[0].x[j] = pp[0].x[i0]; pp[0].x[i0] = i;
        }
        for (j = 0, i1--; j < i1; j++, i1--) {
            i = pp[1].n[j]; pp[1].n[j] = pp[1].n[i1]; pp[1].n[i1] = i;
            i = pp[1].x[j]; pp[1].x[j] = pp[1].x[i1]; pp[1].x[i1] = i;
        }
        if (fd >= 0)
            (void) close(fd);
        if (fj) {
            (void) unlink(jname);
            fj = 0;
            offset = 0;         }                                               }
```

Table 1 (cont')

```
/*
 * write a filled jmp struct offset of the prev one (if any): nw( )
 */
writejmps(ix)                                                                    writejmps
        int     ix;
{
        char    *mktemp( );

if (!fj) {
                if (mktemp(jname) < 0) {
                        fprintf(stderr, "%s: can't mktemp( ) %s\n", prog, jname);
                        cleanup(1);
                }
                if ((fj = fopen(jname, "w")) == 0) {
                        fprintf(stderr, "%s: can't write %s\n", prog, jname);
                        exit(1);
                }
        }
        (void) fwrite((char *)&dx[ix].jp, sizeof(struct jmp), 1, fj);
        (void) fwrite((char *)&dx[ix].offset, sizeof(dx[ix].offset), 1, fj);
}
```

TABLE 2

| | | |
|---|---|---|
| PRO | XXXXXXXXXXXXXXX | (Length = 15 amino acids) |
| Comparison Protein | XXXXXYYYYYYY | (Length = 12 amino acids) |

% amino acid sequence identity = (the number of identically matching amino acid residues between the two polypeptide sequences as determined by ALIGN-2) divided by (the total number of amino acid residues of the PRO polypeptide) = 5 divided by 15 = 33.3%

TABLE 3

| | | |
|---|---|---|
| PRO | XXXXXXXXXX | (Length = 10 amino acids) |
| Comparison Protein | XXXXXYYYYYYZZYZ | (Length = 15 amino acids) |

% amino acid sequence identity = (the number of identically matching amino acid residues between the two polypeptide sequences as determined by ALIGN-2) divided by (the total number of amino acid residues of the PRO polypeptide) = 5 divided by 10 = 50%

TABLE 4

| | | |
|---|---|---|
| PRO-DNA | NNNNNNNNNNNNNN | (Length = 14 nucleotides) |
| Comparison DNA | NNNNNNLLLLLLLLLL | (Length = 16 nucleotides) |

% nucleic acid sequence identity = (the number of identically matching nucleotides between the two nucleic acid sequences as determined by ALIGN-2) divided by (the total number of nucleotides of the PRO-DNA nucleic acid sequence) = 6 divided by 14 = 42.9%

TABLE 5

| | | |
|---|---|---|
| PRO-DNA | NNNNNNNNNNNN | (Length = 12 nucleotides) |
| Comparison DNA | NNNNLLLVV | (Length = 9 nucleotides) |

% nucleic acid sequence identity = (the number of identically matching nucleotides between the two nucleic acid sequences as determined by ALIGN-2) divided by (the total number of nucleotides of the PRO-DNA nucleic acid sequence) = 4 divided by 12 = 33.3%

5.2. Compositions and Methods of the Invention

5.2.1. PRO Variants

In addition to the full-length native sequence PRO polypeptides described herein, it is contemplated that PRO variants can be prepared. PRO variants can be prepared by introducing appropriate nucleotide changes into the PRO DNA, and/or by synthesis of the desired PRO polypeptide. Those skilled in the art will appreciate that amino acid changes may alter post-translational processes of the PRO polypeptide such as changing the number or position of glycosylation sites or altering the membrane anchoring characteristics.

Variations in the native full-length sequence PRO polypeptide or in various domains of the PRO polypeptide described herein, can be made, for example, using any of the techniques and guidelines for conservative and non-conservative mutations set forth, for instance, in U.S. Pat. No. 5,364,934. Variations may be a substitution, deletion or insertion of one or more codons encoding the PRO polypeptide that results in a change in the amino acid sequence of the PRO polypeptide as compared with the native sequence PRO polypeptide. Optionally the variation is by substitution of at least one amino acid with any other amino acid in one or more of the domains of the PRO polypeptide. Guidance in determining which amino acid residue maybe inserted, substituted or deleted without adversely affecting the desired activity may be found by comparing the sequence of the PRO polypeptide with that of homologous known protein molecules and minimizing the number of amino acid sequence changes made in regions of high homology. Amino acid substitutions can be the result of replacing one amino acid with another amino acid having similar structural and/or chemical properties, such as the replacement of a leucine with a serine, i.e., conservative amino acid replacements. Insertions or deletions may optionally be in the range of about 1 to 5 amino acids. The variation allowed may be determined by systematically making insertions, deletions or substitutions of amino acids in the sequence and testing the resulting variants for activity exhibited by the full-length or mature native sequence.

In particular embodiments, conservative substitutions of interest are shown in Table 6 under the heading of preferred substitutions. If such substitutions result in a change in biological activity, then more substantial changes, denominated exemplary substitutions in Table 6, or as further described below in reference to amino acid classes, are introduced and the products screened.

TABLE 6

| Original Residue | Exemplary Substitutions | Preferred Substitutions |
|---|---|---|
| Ala (A) | val; leu; ile | val |
| Arg (R) | lys; gln; asn | lys |
| Asn (N) | gln; his; lys; arg | gln |
| Asp (D) | glu | glu |
| Cys (C) | ser | ser |
| Gln (Q) | asn | asn |
| Glu (E) | asp | asp |
| Gly (G) | pro; ala | ala |
| His (H) | asn; gln; lys; arg | arg |
| Ile (I) | leu; val; met; ala; phe; norleucine | leu |
| Leu (L) | norleucine; ile; val; met; ala; phe | ile |
| Lys (K) | arg; gln; asn | arg |
| Met (M) | leu; phe; ile | leu |
| Phe (F) | leu; val; ile; ala; tyr | leu |
| Pro (P) | ala | ala |
| Ser (S) | thr | thr |
| Thr (T) | ser | ser |
| Trp (W) | tyr; phe | tyr |
| Tyr (Y) | trp; phe; thr; ser | phe |
| Val (V) | ile; leu; met; phe; ala; norleucine | leu |

Substantial modifications in function or immunological identity of the PRO polypeptide are accomplished by selecting substitutions that differ significantly in their effect on maintaining (a) the structure of the polypeptide backbone in the area of the substitution, for example, as a sheet or helical conformation, (b) the charge or hydrophobicity of the molecule at the target site, or (c) the bulk of the side chain. Naturally occurring residues are divided into groups based on common side-chain properties:
(1) hydrophobic: norleucine, met, ala, val, leu, ile;
(2) neutral hydrophilic: cys, ser, thr;
(3) acidic: asp, glu;
(4) basic: asn, gln, his, lys, arg;
(5) residues that influence chain orientation: gly, pro; and
(6) aromatic: trp, tyr, phe.

Non-conservative substitutions will entail exchanging a member of one of these classes for another class. Such substituted residues also may be introduced into the conservative substitution sites or, more preferably, into the remaining (non-conserved) sites.

The variations can be made using methods known in the art such as oligonucleotide-mediated (site-directed) mutagenesis, alanine scanning, and PCR mutagenesis. Site-directed mutagenesis [Carter et al., *Nucl. Acids Res.*, 13:4331 (1986); Zoller et al., *Nucl. Acids Res.*, 10:6487 (1987)], cassette mutagenesis [Wells et al., *Gene*, 34:315 (1985)], restriction selection mutagenesis [Wells et al., *Philos. Trans. R. Soc. London SerA*, 317:415 (1986)] or other known techniques can be performed on the cloned DNA to produce the PRO variant DNA.

Scanning amino acid analysis can also be employed to identify one or more amino acids along a contiguous sequence. Among the preferred scanning amino acids are relatively small, neutral amino acids. Such amino acids include alanine, glycine, serine, and cysteine. Alanine is typically a preferred scanning amino acid among this group because it eliminates the side-chain beyond the beta-carbon and is less likely to alter the main-chain conformation of the variant [Cunningham and Wells, *Science*, 244: 1081–1085 (1989)]. Alanine is also typically preferred because it is the most common amino acid. Further, it is frequently found in both buried and exposed positions [Creighton, *The Proteins*, (W.H. Freeman & Co., N.Y.); Chothia, *J. Mol. Biol.*, 150: 1 (1976)]. If alanine substitution does not yield adequate amounts of variant, an isoteric amino acid can be used.

5.2.2. Modifications of PRO Polypeptides

Covalent modifications of PRO polypeptides are included within the scope of this invention. One type of covalent modification includes reacting targeted amino acid residues of a PRO polypeptide with an organic derivatizing agent that is capable of reacting with selected side chains or the N- or C-terminal residues of the PRO polypeptide. Derivatization with bifunctional agents is useful, for instance, for crosslinking the PRO polypeptide to a water-insoluble support matrix or surface for use in the method for purifying anti-PRO antibodies, and vice-versa. Commonly used crosslinking agents include, e.g., 1,1-bis(diazoacetyl)-2-phenylethane, glutaraldehyde, N-hydroxysuccinimide esters, for example, esters with 4-azidosalicylic acid, homobifunctional imidoesters, including disuccinimidyl esters such as 3,3'-dithiobis(succinimidylpropionate), bifunctional maleimides such as bis-N-maleimido-1,8-octane and agents such as methyl-3-[(p-azidophenyl)dithio]propioimidate.

Other modifications include deamidation of glutaminyl and asparaginyl residues to the corresponding glutamyl and aspartyl residues, respectively, hydroxylation of proline and lysine, phosphorylation of hydroxyl groups of seryl or threonyl residues, methylation of the α-amino groups of lysine, arginine, and histidine side chains [T. E. Creighton, *Proteins: Structure and Molecular Properties*, W.H. Freeman & Co., San Francisco, pp. 79–86 (1983)], acetylation of the N-terminal amine, and amidation of any C-terminal carboxyl group.

Another type of covalent modification of the PRO polypeptide included within the scope of this invention comprises altering the native glycosylation pattern of the polypeptide. "Altering the native glycosylation pattern" is intended for purposes herein to mean deleting one or more carbohydrate moieties found in the native sequence PRO polypeptide (either by removing the underlying glycosylation site or by deleting the glycosylation by chemical and/or enzymatic means), and/or adding one or more glycosylation sites that are not present in the native sequence PRO polypeptide. In addition, the phrase includes qualitative changes in the glycosylation of the native proteins, involving a change in the nature and proportions of the various carbohydrate moieties present.

Addition of glycosylation sites to the PRO polypeptide may be accomplished by altering the amino acid sequence. The alteration may be made, for example, by the addition of, or substitution by, one or more serine or threonine residues to the native sequence PRO polypeptide (for O-linked glycosylation sites). The PRO amino acid sequence may optionally be altered through changes at the DNA level, particularly by mutating the DNA encoding the PRO polypeptide at preselected bases such that codons are generated that will translate into the desired amino acids.

Another means of increasing the number of carbohydrate moieties on the PRO polypeptide is by chemical or enzymatic coupling of glycosides to the polypeptide. Such methods are described in the art, e.g., in WO 87/05330 published Sep. 11, 1987, and in Aplin and Wriston, *CRC Crit. Rev. Biochem.*, pp.259–306 (1981).

Removal of carbohydrate moieties present on the PRO polypeptide may be accomplished chemically or enzymatically or by mutational substitution of codons encoding for amino acid residues that serve as targets for glycosylation. Chemical deglycosylation techniques are known in the art and described, for instance, by Hakimuddin, et al., *Arch. Biochem. Biophys.*, 259:52 (1987) and by Edge et al., *Anal. Biochem.*, 118: 131 (1981). Enzymatic cleavage of carbohydrate moieties on polypeptides can be achieved by the use of a variety of endo- and exo-glycosidases as described by Thotakura et al., *Meth. Enzymol.*, 138:350 (1987).

Another type of covalent modification of the PRO polypeptide comprises linking the PRO polypeptide to one of a variety of nonproteinaceous polymers, e.g., polyethylene glycol (PEG), polypropylene glycol, or polyoxyalkylenes, in the manner set forth in U.S. Pat. Nos. 4,640,835; 4,496,689; 4,301,144; 4,670,417; 4,791,192 or 4,179,337.

The PRO polypeptide of the present invention may also be modified in a way to form a chimeric molecule comprising the PRO polypeptide fused to another, heterologous polypeptide or amino acid sequence.

In one embodiment, such a chimeric molecule comprises a fusion of the PRO polypeptide with a protein transduction domain which targets the PRO polypeptide for delivery to various tissues and more particularly across the brain blood barrier, using, for example, the protein transduction domain of human immunodeficiency virus TAT protein (Schwarze et al., 1999, *Science* 285: 1569–72).

In another embodiment, such a chimeric molecule comprises a fusion of the PRO polypeptide with a tag polypeptide which provides an epitope to which an anti-tag antibody can selectively bind. The epitope tag is generally placed at the amino- or carboxyl-terminus of the PRO polypeptide. The presence of such epitope-tagged forms of the PRO polypeptide can be detected using an antibody against the tag polypeptide. Also, provision of the epitope tag enables the PRO polypeptide to be readily purified by affinity purification using an anti-tag antibody or another type of affinity matrix that binds to the epitope tag. Various tag polypeptides and their respective antibodies are well known in the art. Examples include poly-histidine (poly-His) or poly-histidine-glycine (poly-His-gly) tags; the flu HA tag polypeptide and its antibody 12CA5 [Field et al., *Mol. Cell. Biol.*, 8:2159–2165 (1988)]; the c-myc tag and the 8F9, 3C7, 6E10, G4, B7 and 9E10 antibodies thereto [Evan et al., *Molecular and Cellular Biology*, 5:3610–3616 (1985)]; and the Herpes Simplex virus glycoprotein D (gD) tag and its antibody [Paborsky et al., *Protein Engineering*, 3(6):547–553 (1990)]. Other tag polypeptides include the Flag-peptide [Hopp et al., *BioTechnology*, 6:1204–1210 (1988)]; the KT3 epitope peptide [Martin et al., *Science*, 255:192–194 (1992)]; an α-tubulin epitope peptide [Skinner et al., *J. Biol. Chem.*, 266:15163–15166 (1991)]; and the T7 gene 10 protein peptide tag [Lutz-Freyermuth et al., *Proc. Natl. Acad. Sci. USA*, 87:6393–6397 (1990)].

In an alternative embodiment, the chimeric molecule may comprise a fusion of the PRO polypeptide with an immunoglobulin or a particular region of an immunoglobulin. For a bivalent form of the chimeric molecule (also referred to as an "immunoadhesin"), such a fusion could be to the Fc region of an IgG molecule. The Ig fusions preferably include the substitution of a soluble (transmembrane domain deleted or inactivated) form of a PRO polypeptide in place of at least one variable region within an Ig molecule. In a particularly preferred embodiment, the immunoglobulin fusion includes the hinge, CH2 and CH3, or the hinge, CH1, CH2 and CH3 regions of an IgG1 molecule. For the production of immunoglobulin fusions see also, U.S. Pat. No. 5,428,130 issued Jun. 27, 1995.

5.2.3. Preparation of the PRO Polypeptide

The present invention provides newly identified and isolated nucleotide sequences encoding polypeptides referred to in the present application as PRO polypeptides. In particular, cDNAs encoding PRO polypeptides have been identified and isolated, as disclosed in further detail in the Examples below. It is noted that proteins produced in separate expression rounds may be given different PRO numbers but the UNQ number is unique for any given DNA and the encoded protein, and will not be changed. However, for sake of simplicity, in the present specification the protein encoded by the PRO DNA as well as all further native homologues and variants included in the foregoing definition of PRO polypeptides, will be referred to as "PRO" regardless of their origin or mode of preparation.

The description below relates primarily to production of PRO polypeptides by culturing cells transformed or transfected with a vector containing nucleic acid encoding PRO polypeptides. It is, of course, contemplated that alternative methods that are well known in the art may be employed to prepare the PRO polypeptide. For instance, the PRO polypeptide sequence, or portions thereof, may be produced by direct peptide synthesis using solid-phase techniques. See, e.g., Stewart et al., *Solid-Phase Peptide Synthesis* (W.H. Freeman Co.: San Francisco, Calif., 1969); Merrifield, *J. Am. Chem. Soc.*, 85: 2149–2154 (1963). In vitro protein synthesis may be performed using manual techniques or by automation. Automated synthesis may be accomplished, for instance, with an Applied Biosystems Peptide Synthesizer (Foster City, Calif.) using manufacturer's instructions. Various portions of the PRO polypeptide may be chemically synthesized separately and combined using chemical or enzymatic methods to produce the full-length PRO polypeptide.

5.2.3.1. Isolation of DNA Encoding PRO Polypeptides

DNA encoding the PRO polypeptide may be obtained from a cDNA library prepared from tissue believed to possess the mRNA encoding the PRO polypeptide and to express it at a detectable level. Accordingly, DNAs encoding the human PRO polypeptide can be conveniently obtained from cDNA libraries prepared from human tissues, such as described in the Examples. The gene encoding the PRO polypeptide may also be obtained from a genomic library or by oligonucleotide synthesis.

Libraries can be screened with probes (such as antibodies to the PRO polypeptide or oligonucleotides of at least about 20–80 bases) designed to identify the gene of interest or the protein encoded by it. Screening the cDNA or genomic library with the selected probe may be conducted using standard procedures, such as described in Sambrook et al., supra. An alternative means to isolate the gene encoding the PRO polypeptide is to use PCR methodology. Sambrook et al., supra; Dieffenbach et al., *PCR Primer: A Laboratory Manual* (New York: Cold Spring Harbor Laboratory Press, 1995).

The Examples below describe techniques for screening a cDNA library. The oligonucleotide sequences selected as probes should be of sufficient length and sufficiently unambiguous that false positives are minimized. The oligonucleotide is preferably labeled such that it can be detected upon hybridization to DNA in the library being screened. Methods of labeling are well known in the art, and include the use of radiolabels like $^{32}$P-labeled ATP, biotinylation, or enzyme labeling. Hybridization conditions, including moderate stringency and high stringency, are provided in Sambrook et al., supra.

Sequences identified in such library screening methods can be compared and aligned to other known sequences deposited and available in public databases such as GenBank or other private sequence databases. Sequence identity (at either the amino acid or nucleotide level) within defined regions of the molecule or across the full-length sequence can be determined through sequence alignment using computer software programs such as ALIGN, DNAstar, and INHERIT, which employ various algorithms to measure homology.

Nucleic acid having protein coding sequence may be obtained by screening selected cDNA or genomic libraries using the deduced amino acid sequence disclosed herein for the first time, and, if necessary, using conventional primer extension procedures as described in Sambrook et al., supra, to detect precursors and processing intermediates of mRNA that may not have been reverse-transcribed into cDNA.

5.2.3.2. Selection and Transformation of Host Cells

Host cells are transfected or transformed with expression or cloning vectors described herein for PRO polypeptide production and cultured in conventional nutrient media modified as appropriate for inducing promoters, selecting transformants, or amplifying the genes encoding the desired sequences. The culture conditions, such as media, temperature, pH, and the like, can be selected by the skilled artisan without undue experimentation. In general, principles, protocols, and practical techniques for maximizing the productivity of cell cultures can be found in *Mammalian Cell Biotechnology: A Practical Approach*, M. Butler, ed. (IRL Press, 1991) and Sambrook et al., supra.

Methods of transfection are known to the ordinarily skilled artisan, for example, CaPO$_4$ treatment and electroporation. Depending on the host cell used, transformation is performed using standard techniques appropriate to such cells. The calcium treatment employing calcium chloride, as described in Sambrook et al., supra, or electroporation is generally used for prokaryotes or other cells that contain substantial cell-wall barriers. Infection with *Agrobacterium tumefaciens* is used for transformation of certain plant cells, as described by Shaw et al., *Gene*, 23: 315 (1983) and WO 89/05859 published Jun. 29, 1989. For mammalian cells without such cell walls, the calcium phosphate precipitation method of Graham and van der Eb, *Virology*, 52:456–457 (1978) can be employed. General aspects of mammalian cell host system transformations have been described in U.S. Pat. No. 4,399,216. Transformations into yeast are typically carried out according to the method of Van Solingen et al., *J. Bact.*, 130: 946 (1977) and Hsiao el al, *Proc. Natl. Acad. Sci.* (*USA*), 76: 3829 (1979). However, other methods for introducing DNA into cells, such as by nuclear microinjection, electroporation, bacterial protoplast fusion with intact cells, or polycations, e.g., polybrene or polyornithine, may also be used. For various techniques for transforming mammalian cells, see, Keown et al., *Methods in Enzymology,* 185: 527–537 (1990) and Mansour et al., *Nature,* 336: 348–352 (1988).

Suitable host cells for cloning or expressing the DNA in the vectors herein include prokaryote, yeast, or higher eukaryote cells. Suitable prokaryotes include, but are not limited to, eubacteria, such as Gram-negative or Gram-positive organisms, for example, Enterobacteriaceac such as *E. coli*. Various *E. coli* strains are publicly available, such as *E. coli* K12 strain MM294 (ATCC 31,446); *E. coli* X1776 (ATCC 31,537); *E. coli* strain W3110 (ATCC 27,325); and K5772 (ATCC 53,635). Other suitable prokaryotic host cells include Enterobacteriaceae such as Escherichia, e.g., *E. coli,* Enterobacter, Erwinia, Klebsiella, Proteus, Salmonella, e.g., *Salmonella typhimurium,* Serratia, e.g., *Serratia marcescans,* and Shigella, as well as Bacilli such as *B. subtilis* and *B. licheniformis* (e.g., *B. licheniformis* 41 P disclosed in DD 266,710 published Apr. 12, 1989), Pseudomonas such as *P. aeruginosa,* and Streptomyces. These examples are illustrative rather than limiting. Strain W3110 is one particularly preferred host or parent host because it is a common host strain for recombinant DNA product fermentations. Preferably, the host cell secretes minimal amounts of proteolytic enzymes. For example, strain W3110 may be modified to effect a genetic mutation in the genes encoding proteins endogenous to the host, with examples of such hosts including *E. coli* W3110 strain 1A2, which has the complete genotype tonA; *E. coli* W3110 strain 9E4, which has the complete genotype tonA ptr3; *E. coli* W3110 strain 27C7 (ATCC 55,244), which has the complete genotype tonA ptr3 phoA E15 (argF-lac) 169 degP ompT kan$^r$; *E. coli* W3110 strain 37D6, which has the complete genotype tonA ptr3 phoA E15 (argF-lac) 169 degP ompT rbs7 ilvG kan$^r$; *E. coli* W3110 strain 40B4, which is strain 37D6 with a non-kanamycin resistant degP deletion mutation; and an *E. coli* strain having mutant periplasmic protease disclosed in U.S. Pat. No. 4,946,783 issued Aug. 7, 1990. Alternatively, in vitro methods of cloning, e.g., PCR or other nucleic acid polymerase reactions, are suitable.

In addition to prokaryotes, eukaryotic microbes such as filamentous fungi or yeast are suitable cloning or expression hosts for vectors encoding the PRO polypeptide. *Saccharomyces cerevisiae* is a commonly used lower eukaryotic host microorganism. Others include *Schizosaccharomyces pombe* (Beach and Nurse, *Nature,* 290: 140 [1981]; EP 139,383 published May 2, 1985); Kluyveromyces hosts (U.S. Pat. No. 4,943,529; Fleer et al, *Bio/Technology,* 9: 968–975 (1991)) such as, e.g., *K. lactis* (MW98–8C, CBS683, CBS4574; Louvencourt et al., *J. Bacteriol.,* 737 [1983]), *K. fragilis* (ATCC 12,424), *K. bulgaricus* (ATCC 16,045), *K. wickeramii* (ATCC 24,178), *K. waltii* (ATCC 56,500), *K. drosophilarum* (ATCC 36,906; Van den Berg et al., *Bio/Technology,* 8: 135 (1990)), *K. thermotolerans,* and *K. marxianus; yarrowia* (EP402,226); *Pichia pastoris* (EP 183,070; Sreekrishn et al., *J. Basic Microbiol.,* 28: 265–278 [1988]); Candida; *Trichoderma reesia* (EP 244,234); *Neurospora crassa* (Case et al., *Proc. Natl. Acad. Sci. USA,* 76: 5259–5263 [1979]); Schwanniomyces such as *Schwanniomyces occidentalis* (EP 394,538 published Oct. 31, 1990); and filamentous fungi such as, e.g., Neurospora, Penicillium, Tolypocladium (WO 91/00357 published Jan. 10, 1991), and Aspergillus hosts such as *A. nidulans* (Ballance et al., *Biochem. Biophys. Res. Commun.,* 112: 284–289 [1983]; Tilburn et al., *Gene,* 26: 205–221 [1983]; Yelton et al., *Proc. Natl. Acad. Sci. USA,* 81: 1470–1474 [1984]) and *A. niger* (Kelly and Hynes, *EMBO J.,* 4: 475–479 [1985]). Methylotropic yeasts are suitable herein and include, but are not limited to, yeast capable of growth on methanol selected from the genera consisting of Hansenula, Candida, Kloeckera, Pichia, Saccharomyces, Torulopsis, and Rhodotorula. A list of specific species that are exemplary of this class of yeasts may be found in C. Anthony, *The Biochemistry of Methylotrophs,* 269 (1982).

Suitable host cells for the expression of nucleic acid encoding glycosylated PRO polypeptides are derived from multicellular organisms. Examples of invertebrate cells include insect cells such as Drosophila S2 and Spodoptera Sf9, as well as plant cells. Examples of useful mammalian host cell lines include Chinese hamster ovary (CHO) and COS cells. More specific examples include monkey kidney CV1 line transformed by SV40 (COS-7, ATCC CRL 1651); human embryonic kidney line (293 or 293 cells subcloned for growth in suspension culture, Graham et al., *J. Gen. Virol.,* 36: 59 (1977)); Chinese hamster ovary cells/-DHFR (CHO, Urlaub and Chasin, *Proc. Natl. Acad. Sci. USA,* 77:4216 (1980)); mouse sertoli cells (TM4, Mather, *Biol. Reprod.,* 23:243–251 (1980)); human lung cells (W138, ATCC CCL 75); human liver cells (Hep G2, HB 8065); and mouse mammary tumor (MMT 060562, ATCC CCL51). The selection of the appropriate host cell is deemed to be within the skill in the art.

5.2.3.3. Selection and Use of a Replicable Vector

The nucleic acid (e.g., cDNA or genomic DNA) encoding the PRO polypeptide may be inserted into a replicable vector for cloning (amplification of the DNA) or for expression. Various vectors are publicly available. The vector may, for example, be in the form of a plasmid, cosmid, viral particle, or phage. The appropriate nucleic acid sequence may be inserted into the vector by a variety of procedures. In general, DNA is inserted into an appropriate restriction endonuclease site(s) using techniques known in the art. Vector components generally include, but are not limited to, one or more of a signal sequence if the sequence is to be secreted, an origin of replication, one or more marker genes, an enhancer element, a promoter, and a transcription termination sequence. Construction of suitable vectors containing one or more of these components employs standard ligation techniques that are known to the skilled artisan.

The PRO polypeptide may be produced recombinantly not only directly, but also as a fusion polypeptide with a heterologous polypeptide, which may be a signal sequence or other polypeptide having a specific cleavage site at the N-terminus of the mature protein or polypeptide. In general, the signal sequence may be a component of the vector, or it may be a part of the DNA encoding the PRO polypeptide that is inserted into the vector. The signal sequence may be a prokaryotic signal sequence selected, for example, from the group of the alkaline phosphatase, penicillinase, lpp, or heat-stable enterotoxin II leaders. For yeast secretion the signal sequence may be, e.g., the yeast invertase leader, alpha factor leader (including Saccharomyces and Kluyveromyces α-factor leaders, the latter described in U.S. Pat. No. 5,010,182), or acid phosphatase leader, the *C. albicans* glucoamylase leader (EP 362,179 published Apr. 4, 1990), or the signal described in WO 90/13646 published Nov. 15, 1990. In mammalian cell expression, mammalian signal sequences may be used to direct secretion of the protein, such as signal sequences from secreted polypeptides of the same or related species, as well as viral secretory leaders.

Both expression and cloning vectors contain a nucleic acid sequence that enables the vector to replicate in one or more selected host cells. Such sequences are well known for a variety of bacteria, yeast, and viruses. The origin of replication from the plasmid pBR322 is suitable for most Gram-negative bacteria, the 2μ plasmid origin is suitable for yeast, and various viral origins (SV40, polyoma, adenovirus, VSV, or BPV) are useful for cloning vectors in mammalian cells.

Expression and cloning vectors will typically contain a selection gene, also termed a selectable marker. Typical selection genes encode proteins that (a) confer resistance to antibiotics or other toxins, e.g., ampicillin, neomycin, methotrexate, or tetracycline, (b) complement auxotrophic deficiencies, or (c) supply critical nutrients not available from complex media, e.g., the gene encoding D-alanine racemase for Bacilli.

An example of suitable selectable markers for mammalian cells are those that enable the identification of cells competent to take up the nucleic acid encoding the PRO polypeptide such as DHFR or thymidine kinase. An appropriate host cell when wild-type DHFR is employed is the CHO cell line deficient in DHFR activity, prepared and propagated as described by Urlaub et al., *Proc. Natl. Acad. Sci. USA,* 77: 4216 (1980). A suitable selection gene foruse in yeast is the trpl gene present in the yeast plasmid YRp7. Stinchcomb et al., *Nature,* 282: 39 (1979); Kingsman et al., *Gene,* 7: 141 (1979); Tschemper et al., *Gene,* 10: 157 (1980). The trp1 gene provides a selection marker for a mutant strain of yeast lacking the ability to grow in tryptophan, for example, ATCC No. 44076 or PEP4–1. Jones, *Genetics,* 85: 12 (1977).

Expression and cloning vectors usually contain a promoter operably linked to the nucleic acid sequence encoding the PRO polypeptide to direct mRNA synthesis. Promoters recognized by a variety of potential host cells are well known. Promoters suitable for use with prokaryotic hosts include the β-lactamase and lactose promoter systems (Chang et al., *Nature,* 275: 615 (1978); Goeddel et al., *Nature,* 281: 544 (1979)), alkaline phosphatase, a tryptophan (trp) promoter system (Goeddel, *Nucleic Acids Res.,* 8: 4057 (1980); EP 36,776), and hybrid promoters such as the tac promoter (deBoer et al., *Proc. Natl. Acad. Sci. USA,* 80: 21–25 (1983)). Promoters for use in bacterial systems also will contain a Shine-Dalgarno (S.D.) sequence operably linked to the DNA encoding the PRO polypeptide.

Examples of suitable promoting sequences for use with yeast hosts include the promoters for 3-phosphoglycerate kinase (Hitzeman et al., *J. Biol. Chem.,* 255: 2073 (1980)) or other glycolytic enzymes (Hess et al., *J. Adv. Enzyme Reg.,* 7: 149 (1968); Holland, *Biochemistry,* 17: 4900(1978)), such as enolase, glyceraldehyde-3-phosphate dehydrogenase, hexokinase, pyruvate decarboxylase, phosphofructokinase, glucose-6-phosphate isomerase, 3-phosphoglycerate mutase, pyruvate kinase, triosephosphate isomerase, phosphoglucose isomerase, and glucokinase.

Other yeast promoters that are inducible promoters having the additional advantage of transcription controlled by growth conditions are the promoter regions for alcohol dehydrogenase 2, isocytochrome C, acid phosphatase, degradative enzymes associated with nitrogen metabolism, metallothionein, glyceraldehyde-3-phosphate dehydrogenase, and enzymes responsible for maltose and galactose utilization. Suitable vectors and promoters for use in yeast expression are further described in EP 73,657.

PRO nucleic acid transcription from vectors in mammalian host cells is controlled, for example, by promoters obtained from the genomes of viruses such as polyoma virus, fowlpox virus (UK 2,211,504 published Jul. 5, 1989), adenovirus (such as Adenovirus 2), bovine papilloma virus, avian sarcoma virus, cytomegalovirus, a retrovirus, hepatitis-B virus, and Simian Virus 40 (SV40); by heterologous mammalian promoters, e.g., the actin promoter or an immunoglobulin promoter; and by heat-shock promoters, provided such promoters are compatible with the host cell systems.

Transcription of a DNA encoding the PRO polypeptide by higher eukaryotes may be increased by inserting an enhancer sequence into the vector. Enhancers are cis-acting elements of DNA, usually about from 10 to 300 bp, that act on a promoter to increase its transcription. Many enhancer sequences are now known from mammalian genes (globin, elastase, albumin, α-fetoprotein, and insulin). Typically, however, one will use an enhancer from a eukaryotic cell virus. Examples include the SV40 enhancer on the late side of the replication origin (bp 100–270), the cytomegalovirus early promoter enhancer, the polyoma enhancer on the late side of the replication origin, and adenovirus enhancers. The enhancer may be spliced into the vector at a position 5' or 3' to the sequence coding for PRO polypeptides, but is preferably located at a site 5' from the promoter.

Expression vectors used in eukaryotic host cells (yeast, fungi, insect, plant, animal, human, or nucleated cells from other multicellular organisms) will also contain sequences necessary for the termination of transcription and for stabilizing the mRNA. Such sequences are commonly available from the 5' and, occasionally 3', untranslated regions of eukaryotic or viral DNAs or cDNAs. These regions contain nucleotide segments transcribed as polyadenylated fragments in the untranslated portion of the mRNA encoding the PRO polypeptide.

Still other methods, vectors, and host cells suitable for adaptation to the synthesis of the PRO polypeptide in recombinant vertebrate cell culture are described in Gething et al., *Nature,* 293: 620–625 (1981); Mantei et al., *Nature,* 281: 40–46 (1979); EP 117,060; and EP 117,058.

5.2.3.4. Detecting Gene Amplification/Expression

Gene amplification and/or expression may be measured in a sample directly, for example, by conventional Southern blotting, Northern blotting to quantitate the transcription of mRNA (Thomas, *Proc. Natl. Acad. Sci. USA,* 77:5201–5205 (1980)), dot blotting (DNA analysis), or in situ hybridization, using an appropriately labeled probe, based on the sequences provided herein. Alternatively, antibodies may be employed that can recognize specific duplexes, including DNA duplexes, RNA duplexes, and DNA-RNA hybrid duplexes or DNA-protein duplexes. The antibodies in turn may be labeled and the assay may be carried out where the duplex is bound to a surface, so that upon the formation of duplex on the surface, the presence of antibody bound to the duplex can be detected.

Gene expression, alternatively, may be measured by immunological methods, such as immunohistochemical staining of cells or tissue sections and assay of cell culture or body fluids, to quantitate directly the expression of gene product. Antibodies useful for immunohistochemical staining and/or assay of sample fluids may be either monoclonal or polyclonal, and may be prepared in any mammal. Conveniently, the antibodies may be prepared against a native-sequence PRO polypeptide or against a synthetic peptide based on the DNA sequences provided herein or against exogenous sequence fused to DNA encoding the PRO polypeptide and encoding a specific antibody epitope.

5.2.3.5. Purification of PRO Polypeptides

Forms of PRO polypeptides may be recovered from culture medium or from host cell lysates. If membrane-bound, it can be released from the membrane using a suitable detergent solution (e.g., TRITON-X™ 100) or by enzymatic cleavage. Cells employed in expression of nucleic acid encoding the PRO polypeptide can be disrupted by various physical or chemical means, such as freeze-thaw cycling, sonication, mechanical disruption, or cell-lysing agents. It may be desired to purify the PRO polypeptide from recombinant cell proteins or polypeptides. The following procedures are exemplary of suitable purification procedures: by fractionation on an ion-exchange column; ethanol precipitation; reverse phase HPLC; chromatography on silica or on a cation-exchange resin such as DEAE; chromatofocusing; SDS-PAGE; ammonium sulfate precipitation; gel filtration using, for example, Sephadex G-75; protein A Sepharose columns to remove contaminants such as IgG; and metal chelating columns to bind epitope-tagged forms of the PRO polypeptide. Various methods of protein purification may be employed and such methods are known in the art and described, for example, in Deutscher, *Methods in Enzymology*, 182 (1990); Scopes, *Protein Purification: Principles and Practice* (Springer-Verlag: New York, 1982). The purification step(s) selected will depend, for example, on the nature of the production process used and the particular PRO polypeptide produced.

5.2.4. Uses of PRO Polypeptides 5.2.4.1. Assays for Cardiovascular, Endothelial, and Angiogenic Activity Various assays can be used to test the polypeptide herein for cardiovascular, endothelial, and angiogenic activity. Such assays include those provided in the Examples below.

Assays for testing for endothelin antagonist activity, as disclosed in U.S. Pat. No. 5,773,414, include a rat heart ventricle binding assay where the polypeptide is tested for its ability to inhibit iodinized endothelin-1 binding in a receptor assay, an endothelin receptor binding assay testing for intact cell binding of radiolabeled endothelin-1 using rabbit renal artery vascular smooth muscle cells, an inositol phosphate accumulation assay where functional activity is determined in Rat-1 cells by measuring intra-cellular levels of second messengers, an arachidonic acid release assay that measures the ability of added compounds to reduce endothelin-stimulated arachidonic acid release in cultured vascular smooth muscles, in vitro (isolated vessel) studies using endothelium from male New Zealand rabbits, and in vivo studies using male Sprague-Dawley rats.

Assays for tissue generation activity include, without limitation, those described in WO 95/16035 (bone, cartilage, tendon); WO 95/05846 (nerve, neuronal), and WO 91/07491 (skin, endothelium).

Assays for wound-healing activity include, for example, those described in Winter, *Epidermal Wound Healing*, Maibach, H I and Rovee, D T, eds. (Year Book Medical Publishers, Inc., Chicago), pp.71–112, as modified by the article of Eaglstein and Mertz, *J. Invest. Dermatol.*, 71: 382–384 (1978).

An assay to screen for a test molecule relating to a PRO polypeptide that binds an endothelin $B_1$ ($ETB_1$) receptor polypeptide and modulates signal transduction activity involves providing a host cell transformed with a DNA encoding endothelin $B_1$ receptor polypeptide, exposing the cells to the test candidate, and measuring endothelin $B_1$ receptor signal transduction activity, as described, e.g., in U.S. Pat. No. 5,773,223.

There are several cardiac hypertrophy assays. In vitro assays include induction of spreading of adult rat cardiac myocytes. In this assay, ventricular myocytes are isolated from a single (male Sprague-Dawley) rat, essentially following a modification of the procedure described in detail by Piper et al., "Adult ventricular rat heart muscle cells" in *Cell Culture Techniques in Heart and Vessel Research*, H. M. Piper, ed. (Berlin: Springer-Verlag, 1990), pp.36–60. This procedure permits the isolation of adult ventricular myocytes and the long-term culture of these cells in the rod-shaped phenotype. Phenylephrine and Prostaglamidin $F_{2\alpha}$, ($PGF_{2\alpha}$) have been shown to induce a spreading response in these adult cells. The inhibition of myocyte spreading induced by $PGF_{2\alpha}$ or $PGF_{2\alpha}$ analogs (e.g., fluprostenol) and phenylephrine by various potential inhibitors of cardiac hypertrophy is then tested.

One example of an in vivo assay is a test for inhibiting cardiac hypertrophy induced by fluprostenol in vivo. This pharmacological model tests the ability of the PRO polypeptide to inhibit cardiac hypertrophy induced in rats (e.g., male Wistar or Sprague-Dawley) by subcutaneous injection of fluprostenol (an agonist analog of $PGF_{2\alpha}$). It is known that rats with pathologic cardiac hypertrophy induced by myocardial infarction have chronically elevated levels of extractable $PGF_{2\alpha}$ in their myocardium. Lai et al., *Am. J. Physiol.* (*Heart Circ. Physiol.*), 271: H2197-H2208 (1996). Accordingly, factors that can inhibit the effects of fluprostenol on myocardial growth in vivo are potentially useful for treating cardiac hypertrophy. The effects of the PRO polypeptide on cardiac hypertrophy are determined by measuring the weight of heart, ventricles, and left ventricle (normalized by body weight) relative to fluprostenol-treated rats not receiving the PRO polypeptide.

Another example of an in vivo assay is the pressure-overload cardiac hypertrophy assay. For in vivo testing it is common to induce pressure-overload cardiac hypertrophy by constriction of the abdominal aorta of test animals. In a typical protocol, rats (e.g., male Wistar or Sprague-Dawley) are treated under anesthesia, and the abdominal aorta of each rat is narrowed down just below the diaphragm. Beznak M., *Can. J. Biochem. Physiol.*, 33: 985–94 (1955). The aorta is exposed through a surgical incision, and a blunted needle is placed next to the vessel. The aorta is constricted with a ligature of silk thread around the needle, which is immediately removed and which reduces the lumen of the aorta to the diameter of the needle. This approach is described, for example, in Rossi et al., *Am. Heart J.*, 124: 700–709 (1992) and O'Rourke and Reibel, *P.S.E.M.B.*, 200: 95–100 (1992).

In yet another in vivo assay, the effect on cardiac hypertrophy following experimentally induced myocardial infarction (MI) is measured. Acute MI is induced in rats by left coronary artery ligation and confirmed by electrocardiographic examination. A sham-operated group of animals is also prepared as control animals. Earlier data have shown that cardiac hypertrophy is present in the group of animals with MI, as evidenced by an 18% increase in heart weight-to-body weight ratio. Lai et al., supra. Treatment of these animals with candidate blockers of cardiac hypertrophy, e.g., the PRO polypeptide, provides valuable information about the therapeutic potential of the candidates tested. One further such assay test for induction of cardiac hypertrophy is disclosed in U.S. Pat. No. 5,773,415, using Sprague-Dawley rats.

For cancer, a variety of well-known animal models can be used to further understand the role of the genes identified herein in the development and pathogenesis of tumors, and to test the efficacy of candidate therapeutic agents, including antibodies and other antagonists of native PRO polypeptides, such as small-molecule antagonists. The in vivo nature of such models makes them particularly predictive of responses in human patients. Animal models of tumors and cancers (e.g., breast cancer, colon cancer, prostate cancer, lung cancer, etc.) include both non-recombinant and recombinant (transgenic) animals. Non-recombinant animal models include, for example, rodent, e.g., murine models. Such models can be generated by introducing tumor cells into syngeneic mice using standard techniques, e.g., subcutaneous injection, tail vein injection, spleen implantation, intraperitoneal implantation, implantation under the renal capsule, or orthopin implantation, e.g., colon cancer cells implanted in colonic tissue. See, e.g., PCT publication No. WO 97/33551, published Sep. 18, 1997. Probably the most often used animal species in oncological studies are immunodeficient mice and, in particular, nude mice. The observation that the nude mouse with thymic hypo/aplasia could successfully act as a host for human tumor xenografts has lead to its widespread use for this purpose. The autosomal recessive nu gene has been introduced into a very large number of distinct congenic strains of nude mouse, including, for example, ASW, A/He, AKR, BALB/c, B10.LP, C17, C3H, C57BL, C57, CBA, DBA, DDD, I/st, NC, NFR, NFS, NFS/N, NZB, NZC, NZW, P, RIII, and SJL. In addition, a wide variety of other animals with inherited immunological defects other than the nude mouse have been bred and used as recipients of tumor xenografts. For further details see, e.g., *The Nude Mouse in Oncology Research*, E. Boven and B. Winograd, eds. (CRC Press, Inc., 1991).

The cells introduced into such animals can be derived from known tumor/cancer cell lines, such as any of the above-listed tumor cell lines, and, for example, the B104–1–1 cell line (stable NIH-3T3 cell line transfected with the neu protooncogene); ras-transfected NIH-3T3 cells; Caco-2 (ATCC HTB-37); or a moderately well-differentiated grade II human colon adenocarcinoma cell line, HT-29 (ATCC HTB-38); or from tumors and cancers. Samples of tumor or cancer cells can be obtained from patients undergoing surgery, using standard conditions involving freezing and storing in liquid nitrogen. Karmali et al., *Br. J. Cancer*, 48: 689–696 (1983).

Tumor cells can be introduced into animals such as nude mice by a variety of procedures. The subcutaneous (s.c.) space in mice is very suitable for tumor implantation. Tumors can be transplanted s.c. as solid blocks, as needle biopsies by use of a trochar, or as cell suspensions. For solid-block or trochar implantation, tumor tissue fragments of suitable size are introduced into the s.c. space. Cell suspensions are freshly prepared from primary tumors or stable tumor cell lines, and injected subcutaneously. Tumor cells can also be injected as subdermal implants. In this location, the inoculum is deposited between the lower part of the dermal connective tissue and the s.c. tissue.

Animal models of breast cancer can be generated, for example, by implanting rat neuroblastoma cells (from which the neu oncogene was initially isolated), or neu-transformed NIH-3T3 cells into nude mice, essentially as described by Drebin et al. *Proc. Nat. Acad. Sci. USA,* 83: 9129–9133 (1986).

Similarly, animal models of colon cancer can be generated by passaging colon cancer cells in animals, e.g., nude mice, leading to the appearance of tumors in these animals. An orthotopic transplant model of human colon cancer in nude mice has been described, for example, by Wang et al, *Cancer Research,* 54: 4726–4728 (1994) and Too et al., *Cancer Research,* 55: 681–684 (1995). This model is based on the so-called "METAMOUSE™" sold by AntiCancer, Inc., (San Diego, Calif.).

Tumors that arise in animals can be removed and cultured in vitro. Cells from the in vitro cultures can then be passaged to animals. Such tumors can serve as targets for further testing or drug screening. Alternatively, the tumors resulting from the passage can be isolated and RNA from pre-passage cells and cells isolated after one or more rounds of passage analyzed for differential expression of genes of interest. Such passaging techniques can be performed with any known tumor or cancer cell lines.

For example, Meth A, CMS4, CMS5, CMS21, and WEHI-164 are chemically induced fibrosarcomas of BALB/c female mice (DeLeo et al., *J. Exp. Med.,* 146: 720 (1977)), which provide a highly controllable model system for studying the anti-tumor activities of various agents. Palladino et al., *J. Immunol.,* 138: 4023–4032 (1987). Briefly, tumor cells are propagated in vitro in cell culture. Prior to injection into the animals, the cell lines are washed and suspended in buffer, at a cell density of about $10 \times 10^6$ to $10 \times 10^7$ cells/ml. The animals are then infected subcutaneously with 10 to 100 µl of the cell suspension, allowing one to three weeks for a tumor to appear.

In addition, the Lewis lung (3LL) carcinoma of mice, which is one of the most thoroughly studied experimental tumors, can be used as an investigational tumor model. Efficacy in this tumor model has been correlated with beneficial effects in the treatment of human patients diagnosed with small-cell carcinoma of the lung (SCCL). This tumor can be introduced in normal mice upon injection of tumor fragments from an affected mouse or of cells maintained in culture. Zupi et al., *Br. J. Cancer,* 41: suppl. 4, 30 (1980). Evidence indicates that tumors can be started from injection of even a single cell and that a very high proportion of infected tumor cells survive. For further information about this tumor model see, Zacharski, *Haemostasis,* 16: 300–320 (1986).

One way of evaluating the efficacy of a test compound in an animal model with an implanted tumor is to measure the size of the tumor before and after treatment. Traditionally, the size of implanted tumors has been measured with a slide caliper in two or three dimensions. The measure limited to two dimensions does not accurately reflect the size of the tumor; therefore, it is usually converted into the corresponding volume by using a mathematical formula. However, the measurement of tumor size is very inaccurate. The therapeutic effects of a drug candidate can be better described as treatment-induced growth delay and specific growth delay. Another important variable in the description of tumor growth is the tumor volume doubling time. Computer programs for the calculation and description of tumor growth are also available, such as the program reported by Rygaard and Spang-Thomsen, *Proc. 6th Int. Workshop on Immune-Deficient Animals*, Wu and Sheng eds. (Basel, 1989), p.301. It is noted, however, that necrosis and inflammatory responses following treatment may actually result in an increase in tumor size, at least initially. Therefore, these changes need to be carefully monitored, by a combination of a morphometric method and flow cytometric analysis.

Further, recombinant (transgenic) animal models can be engineered by introducing the coding portion of the PRO gene identified herein into the genome of animals of interest, using standard techniques for producing transgenic animals. Animals that can serve as a target for transgenic manipulation include, without limitation, mice, rats, rabbits, guinea pigs, sheep, goats, pigs, and non-human primates, e.g., baboons, chimpanzees and monkeys. Techniques known in the art to introduce a transgene into such animals include pronucleic microinjection (U.S. Pat. No. 4,873,191); retrovirus-mediated gene transfer into germ lines (e.g., Van der Putten et al., *Proc. Natl. Acad. Sci. USA,* 82: 6148–615 (1985)); gene targeting in embryonic stem cells (Thompson et al., *Cell*, 56: 313–321 (1989)); electroporation of embryos (Lo, *Mol. Cell. Biol.*, 3: 1803–1814 (1983)); and sperm-mediated gene transfer. Lavitrano et al., *Cell*, 57: 717–73 (1989). For a review, see for example, U.S. Pat. No. 4,736,866.

For the purpose of the present invention, transgenic animals include those that carry the transgene only in part of their cells ("mosaic animals"). The transgene can be integrated either as a single transgene, or in concatamers, e.g., head-to-head or head-to-tail tandems. Selective introduction of a transgene into a particular cell type is also possible by following, for example, the technique of Lasko et al., *Proc. Natl. Acad. Sci. USA*, 89: 6232–636 (1992). The expression of the transgene in transgenic animals can be monitored by standard techniques. For example, Southern blot analysis or PCR amplification can be used to verify the integration of the transgene. The level of mRNA expression can then be analyzed using techniques such as in situ hybridization, Northern blot analysis, PCR, or immunocytochemistry. The animals are further examined for signs of tumor or cancer development.

Alternatively, "knock-out" animals can be constructed that have a defective or altered gene encoding a PRO polypeptide identified herein, as a result of homologous recombination between the endogenous gene encoding the PRO polypeptide and altered genomic DNA encoding the same polypeptide introduced into an embryonic cell of the animal. For example, cDNA encoding a particular PRO polypeptide can be used to clone genomic DNA encoding that polypeptide in accordance with established techniques. A portion of the genomic DNA encoding a particular PRO polypeptide can be deleted or replaced with another gene, such as a gene encoding a selectable marker that can be used to monitor integration. Typically, several kilobases of unaltered flanking DNA (both at the 5' and 3' ends) are included in the vector. See, e.g., Thomas and Capecchi, *Cell*, 51: 503 (1987) for a description of homologous recombination vectors. The vector is introduced into an embryonic stem cell line (e.g., by electroporation) and cells in which the introduced DNA has homologously recombined with the endogenous DNA are selected. See, e.g., Li et al, *Cell*, 69: 915 (1992). The selected cells are then injected into a blastocyst of an animal (e.g., a mouse or rat) to form aggregation chimeras. See, e.g., Bradley, in *Teratocarcinomas and Embivonic Stem Cells: A Practical Approach*, E. J. Robertson, ed. (IRL: Oxford, 1987), pp.113–152. A chimeric embryo can then be implanted into a suitable pseudopregnant female foster animal and the embryo brought to term to create a "knock-out" animal. Progeny harboring the homologously recombined DNA in their germ cells can be identified by standard techniques and used to breed animals in which all cells of the animal contain the homologously recombined DNA. Knockout animals can be charactenzed, for instance, by their ability to defend against certain pathological conditions and by their developmentofpathological conditions due to absence of the PRO polypeptide.

The efficacy of antibodies specifically binding the PRO polypeptides identified herein, and other drug candidates, can be tested also in the treatment of spontaneous animal tumors. A suitable target for such studies is the feline oral squamous cell carcinoma (SCC). Feline oral SCC is a highly invasive, malignant tumor that is the most common oral malignancy of cats, accounting for over 60% of the oral tumors reported in this species. It rarely metastasizes to distant sites, although this low incidence of metastasis may merely be a reflection of the short survival times for cats with this tumor. These tumors are usually not amenable to surgery, primarily because of the anatomy of the feline oral cavity. At present, there is no effective treatment for this tumor. Prior to entry into the study, each cat undergoes complete clinical examination and biopsy, and is scanned by computed tomography (CT). Cats diagnosed with sublingual oral squamous cell tumors are excluded from the study. The tongue can become paralyzed as a result of such tumor, and even if the treatment kills the tumor, the animals may not be able to feed themselves. Each cat is treated repeatedly, over a longer period of time. Photographs of the tumors will be taken daily during the treatment period, and at each subsequent recheck. After treatment, each cat undergoes another CT scan. CT scans and thoracic radiograms are evaluated every 8 weeks thereafter. The data are evaluated for differences in survival, response, and toxicity as compared to control groups. Positive response may require evidence of tumor regression, preferably with improvement of quality of life and/or increased life span.

In addition, other spontaneous animal tumors, such as fibrosarcoma, adenocarcinoma, lymphoma, chondroma, or leiomyosarcoma of dogs, cats, and baboons can also be tested. Of these, mammary adenocarcinoma in dogs and cats is a preferred model as its appearance and behavior are very similar to those in humans. However, the use of this model is limited by the rare occurrence of this type of tumor in animals.

Other in vitro and in vivo cardiovascular, endothelial, and angiogenic tests known in the art are also suitable herein.

5.2.4.2. Tissue Distribution

The results of the cardiovascular, endothelial, and angiogenic assays herein can be verified by further studies, such as by determining mRNA expression in various human tissues.

As noted before, gene amplification and/or gene expression in various tissues may be measured by conventional Southern blotting, Northern blotting to quantitate the transcription of mRNA (Thomas, *Proc. Natl. Acad. Sci. USA*, 77:5201–5205 (1980)), dotblotting (DNA analysis), or in situ hybridization, using an appropriately labeled probe, based on the sequences provided herein. Alternatively, antibodies may be employed that can recognize specific duplexes, including DNA duplexes, RNA duplexes, and DNA-RNA hybrid duplexes or DNA-protein duplexes.

Gene expression in various tissues, alternatively, may be measured by immunological methods, such as immunohistochemical staining of tissue sections and assay of cell culture or body fluids, to quantitate directly the expression of gene product. Antibodies useful for immunohistochemical staining and/or assay of sample fluids may be either monoclonal or polyclonal, and may be prepared in any mammal. Conveniently, the antibodies may be prepared against a native-sequence PRO polypeptide or against a synthetic peptide based on the DNA sequences provided herein or against exogenous sequence fused to PRO DNA and encoding a specific antibody epitope. General techniques for generating antibodies, and special protocols for in situ hybridization are provided hereinbelow.

5.2.4.3. Antibody Binding-Studies

The results of the cardiovascular, endothelial, and angiogenic study can be further verified by antibody binding studies, in which the ability of anti-PRO antibodies to inhibit the effect of the PRO polypeptides on endothelial cells or other cells used in the cardiovascular, endothelial, and angiogenic assays is tested. Exemplary antibodies include polyclonal, monoclonal, humanized, bispecific, and heteroconjugate antibodies, the preparation of which will be described hereinbelow.

Antibody binding studies may be carried out in any known assay method, such as competitive binding assays, direct and indirect sandwich assays, and immunoprecipitation assays. Zola, *Monoclonal Antibodies: A Manual of Techniques* (CRC Press, Inc., 1987), pp.147–158.

Competitive binding assays rely on the ability of a labeled standard to compete with the test sample analyte for binding with a limited amount of antibody. The amount of target protein in the test sample is inversely proportional to the amount of standard that becomes bound to the antibodies. To facilitate determining the amount of standard that becomes bound, the antibodies preferably are insolubilized before or after the competition, so that the standard and analyte that are bound to the antibodies may conveniently be separated from the standard and analyte that remain unbound.

Sandwich assays involve the use of two antibodies, each capable of binding to a different immunogenic portion, or epitope, of the protein to be detected. In a sandwich assay, the test sample analyte is bound by a first antibody that is immobilized on a solid support, and thereafter a second antibody binds to the analyte, thus forming an insoluble three-part complex. See, e.g., U.S. Pat. No. 4,376,110. The second antibody may itself be labeled with a detectable moiety (direct sandwich assays) or may be measured using an anti-immunoglobulin antibody that is labeled with a detectable moiety (indirect sandwich assay). For example, one type of sandwich assay is an ELISA assay, in which case the detectable moiety is an enzyme.

For immunohistochemistry, the tissue sample may be fresh or frozen or may be embedded in paraffin and fixed with a preservative such as formalin, for example.

5.2.4.4. Cell-Based Tumor Assays

Cell-based assays and animal models for cardiovascular, endothelial, and angiogenic disorders, such as tumors, can be used to verify the findings of a cardiovascular, endothelial, and angiogenic assay herein, and further to understand the relationship between the genes identified herein and the development and pathogenesis of undesirable cardiovascular, endothelial, and angiogenic cell growth. The role of gene products identified herein in the development and pathology of undesirable cardiovascular, endothelial, and angiogenic cell growth, e.g., tumor cells, can be tested by using cells or cells lines that have been identified as being stimulated or inhibited by the PRO polypeptide herein. Such cells include, for example, those set forth in the Examples below.

In a different approach, cells of a cell type known to be involved in a particular cardiovascular, endothelial, and angiogenic disorder are transfected with the cDNAs herein, and the ability of these cDNAs to induce excessive growth or inhibit growth is analyzed. If the cardiovascular, endothelial, and angiogenic disorder is cancer, suitable tumor cells include, for example, stable tumor cell lines such as the B104–1–1 cell line (stable NIH-3T3 cell lin transfected with the neu protooncogene) and ras-transfected NIH-3T3 cells, which can be transfected with the desired gene and monitored for tumorigenic growth. Such transfected cell lines can then be used to test the ability of poly- or monoclonal antibodies or antibody compositions to inhibit tumorigenic cell growth by exerting cytostatic or cytotoxic activity on the growth of the transformed cells, or by mediating antibody-dependent cellular cytotoxicity (ADCC). Cells transfected with the coding sequences of the genes identified herein can further be used to identify drug candidates for the treatment of cardiovascular, endothelial, and angiogenic disorders such as cancer.

In addition, primary cultures derived from tumors in transgenic animals (as described above) can be used in the cell-based assays herein, although stable cell lines are preferred. Techniques to derive continuous cell lines from transgenic animals are well known in the art. See, e g., Small et al., *Mol. Cell. Biol.*, 5: 642–648 (1985).

5.2.4.5. Gene Therapy

Described below are methods and compositions whereby disease symptoms may be ameliorated. Certain diseases are brought about, at least in part, by an excessive level of gene product, or by the presence of a gene product exhibiting an abnormal or excessive activity. As such, the reduction in the level and/or activity of such gene products would bring about the amelioration of such disease symptoms.

Alternatively, certain other diseases are brought about, at least in part, by the absence or reduction of the level of gene expression, or a reduction in the level of a gene product's activity. As such, an increase in the level of gene expression and/or the activity of such gene products would bring about the amelioration of such disease symptoms.

In some cases, the up-regulation of a gene in a disease state reflects a protective role for that gene product in responding to the disease condition. Enhancement of such a target gene's expression, or the activity of the target gene product, will reinforce the protective effect it exerts. Some disease states may result from an abnormally low level of activity of such a protective gene. In these cases also, an increase in the level of gene expression and/or the activity of such gene products would bring about the amelioration of such disease symptoms.

The PRO polypeptides described herein and polypeptidyl agonists and antagonists may be employed in accordance with the present invention by expression of such polypeptides in vivo, which is often referred to as gene therapy.

There are two major approaches to getting the nucleic acid (optionally contained in a vector) into the patient's cells: in vivo and ex vivo. For in vivo delivery the nucleic acid is injected directly into the patient, usually at the sites where the PRO polypeptide is required, i.e., the site of synthesis of the PRO polypeptide, if known, and the site (e.g., wound) where biological activity of the PRO polypeptide is needed. For ex vivo treatment, the patient's cells are removed, the nucleic acid is introduced into these isolated cells, and the modified cells are administered to the patient either directly or, for example, encapsulated within porous membranes that are implanted into the patient (see, e.g., U.S. Pat. Nos. 4,892,538 and 5,283,187). There are a variety of techniques available for introducing nucleic acids into viable cells. The techniques vary depending upon whether the nucleic acid is transferred into cultured cells in vitro, or transferred in vivo in the cells of the intended host. Techniques suitable for the transfer of nucleic acid into mammalian cells in vitro include the use of liposomes, electroporation, microinjection, transduction, cell fusion, DEAE-dextran, the calcium phosphate precipitation method, etc. Transduction involves the association of a replication-defective, recombinant viral (preferably retroviral) particle with a cellular receptor, followed by introduction of the nucleic acids contained by the particle into the cell. A commonly used vector for ex vivo delivery of the gene is a retrovirus.

The currently preferred in vivo nucleic acid transfer techniques include transfection with viral or non-viral vectors (such as adenovirus, lentivirus, Herpes simplex I virus, or adeno-associated virus (AAV)) and lipid-based systems (useful lipids for lipid-mediated transfer of the gene are, for example, DOTMA, DOPE, and DC-Chol; see, e.g., Tonkinson et al., *Cancer Investigation*, 14(1): 54–65 (1996)). The most preferred vectors for use in gene therapy are viruses, most preferably adenoviruses, AAV, lentiviruses, or retroviruses. A viral vector such as a retroviral vector includes at least one transcriptional promoter/enhancer or locus-defining element(s), or other elements that control gene expression by other means such as alternate splicing, nuclear RNA export, or post-translational modification of messenger. In addition, a viral vector such as a retroviral vector includes a nucleic acid molecule that, when transcribed in the presence of a gene encoding the PRO polypeptide, is operably linked thereto and acts as a translation initiation sequence. Such vector constructs also include a packaging signal, long terminal repeats (LTRs) or portions thereof, and positive and negative strand primer binding sites appropriate to the virus used (if these are not already present in the viral vector). In addition, such vector typically includes a signal sequence for secretion of the PRO polypeptide from a host cell in which it is placed. Preferably the signal sequence for this purpose is a mammalian signal sequence, most preferably the native signal sequence for the PRO polypeptide. Optionally, the vector construct may also include a signal that directs polyadenylation, as well as one or more restriction sites and a translation termination sequence. By way of example, such vectors will typically include a 5' LTR, a tRNA binding site, a packaging signal, an origin of second-strand DNA synthesis, and a 3' LTR or a portion thereof. Other vectors can be used that are non-viral, such as cationic lipids, polylysine, and dendrimers.

In some situations, it is desirable to provide the nucleic acid source with an agent that targets the target cells, such as an antibody specific for a cell-surface membrane protein or the target cell, a ligand for a receptor on the target cell, etc. Where liposomes are employed, proteins that bind to a cell-surface membrane protein associated with endocytosis may be used for targeting and/or to facilitate uptake, e.g., capsid proteins or fragments thereof tropic for a particular cell type, antibodies for proteins that undergo internalization in cycling, and proteins that target intracellular localization and enhance intracellular half-life. The technique of receptor-mediated endocytosis is described, for example, by Wu et al., *J. Biol. Chem.*, 262: 4429–4432 (1987); and Wagner et al., *Proc. Natl. Acad. Sci. USA*, 87: 3410–3414 (1990). For a review of the currently known gene marking and gene therapy protocols, see, Anderson et al., *Science*, 256: 808–813 (1992). See also WO 93/25673 and the references cited therein.

Suitable gene therapy and methods for making retroviral particles and structural proteins can be found in, e.g., U.S. Pat. No. 5,681,746.

5.2.4.6. Use of Gene as a Diagnostic

This invention is also related to the use of the gene encoding the PRO polypeptide as a diagnostic. Detection of a mutated form of the PRO polypeptide will allow a diagnosis of a cardiovascular, endothelial, and angiogenic disease or a susceptibility to a cardiovascular, endothelial, and angiogenic disease, such as a tumor, since mutations in the PRO polypeptide may cause tumors.

Individuals carrying mutations in the genes encoding a human PRO polypeptide may be detected at the DNA level by a variety of techniques. Nucleic acids for diagnosis may be obtained from a patient's cells, such as from blood, urine, saliva, tissue biopsy, and autopsy material. The genomic DNA may be used directly for detection or may be amplified enzymatically by using PCR (Saiki et al., *Nature*, 324: 163–166(1986)) prior to analysis. RNA or cDNA may also be used for the same purpose. As an example, PCR primers complementary to the nucleic acid encoding the PRO polypeptide can be used to identify and analyze the PRO polypeptide mutations. For example, deletions and insertions can be detected by a change in size of the amplified product in comparison to the normal genotype. Point mutations can be identified by hybridizing amplified DNA to radiolabeled RNA encoding the PRO polypeptide, or alternatively, radiolabeled antisense DNA sequences encoding the PRO polypeptide. Perfectly matched sequences can be distinguished from mismatched duplexes by RNase A digestion or by differences in melting temperatures.

Genetic testing based on DNA sequence differences may be achieved by detection of alteration in electrophoretic mobility of DNA fragments in gels with or without denaturing agents. Small sequence deletions and insertions can be visualized by high resolution gel electrophoresis. DNA fragments of different sequences may be distinguished on denaturing formamidine gradient gels in which the mobilities of different DNA fragments are retarded in the gel at different positions according to their specific melting or partial melting temperatures. See, e.g., Myers et al., *Science*, 230: 1242 (1985).

Sequence changes at specific locations may also be revealed by nuclease protection assays, such as RNase and S1 protection or the chemical cleavage method, for example, Cotton et al., *Proc. Natl. Acad. Sci. USA*, 85: 4397–4401 (1985).

Thus, the detection of a specific DNA sequence may be achieved by methods such as hybridization, RNase protection, chemical cleavage, direct DNA sequencing, or the use of restriction enzymes, e.g., restriction fragment length polymorphisms (RFLP), and Southern blotting of genomic DNA.

5.2.4.7. Use to Detect PRO Polypeptide Levels

In addition to more conventional gel-electrophoresis and DNA sequencing, mutations can also be detected by in situ analysis.

Expression of nucleic acid encoding the PRO polypeptide may be linked to vascular disease or neovascularization associated with tumor formation. If the PRO polypeptide has a signal sequence and the mRNA is highly expressed in endothelial cells and to a lesser extent in smooth muscle cells, this indicates that the PRO polypeptide is present in serum. Accordingly, an anti-PRO polypeptide antibody could be used to diagnose vascular disease or neovascularization associated with tumor formation, since an altered level of this PRO polypeptide may be indicative of such disorders.

A competition assay may be employed wherein antibodies specific to the PRO polypeptide are attached to a solid support and the labeled PRO polypeptide and a sample derived from the host are passed over the solid support and the amount of label detected attached to the solid support can be correlated to a quantity of the PRO polypeptide in the sample.

5.2.4.8. Chromosome Mapping

The sequences of the present invention are also valuable for chromosome identification. The sequence is specifically targeted to and can hybridize with a particular location on an individual human chromosome. Moreover, there is a current need for identifying particular sites on the chromosome. Few chromosome marking reagents based on actual sequence data (repeat polymorphisms) are presently available for marking chromosomal location. The mapping of DNAs to chromosomes according to the present invention is an important first step in correlating those sequences with genes associated with disease.

Briefly, sequences can be mapped to chromosomes by preparing PCR primers (preferably 15–25 bp) from the cDNA. Computer analysis for the 3'-untranslated region is used to rapidly select primers that do not span more than one exon in the genomic DNA, thus complicating the amplification process. These primers are then used for PCR screening of somatic cell hybrids containing individual human chromosomes. Only those hybrids containing the human gene corresponding to the primer will yield an amplified fragment.

PCR mapping of somatic cell hybrids is a rapid procedure for assigning a particular DNA to a particular chromosome. Using the present invention with the same oligonucleotide primers, sublocalization can be achieved with panels of fragments from specific chromosomes or pools of large genomic clones in an analogous manner. Other mapping strategies that can similarly be used to map to its chromosome include in situ hybridization, prescreening with labeled flow-sorted chromosomes, and preselection by hybridization to construct chromosome-specific cDNA libraries.

Fluorescence in situ hybridization (FISH) of a cDNA clone to a metaphase chromosomal spread can be used to provide a precise chromosomal location in one step. This technique can be used with cDNA as short as 500 or 600 bases; however, clones larger than 2,000 bp have a higher likelihood of binding to a unique chromosomal location with sufficient signal intensity for simple detection. FISH requires use of the clones from which the gene encoding the PRO polypeptide was derived, and the longer the better. For example, 2,000 bp is good, 4,000 bp is better, and more than 4,000 is probably not necessary to get good results a reasonable percentage of the time. For a review of this technique, see, Verma et al., *Human Chromosomes: a Manual of Basic Techniques* (Pergamon Press, New York, 1988).

Once a sequence has been mapped to a precise chromosomal location, the physical position of the sequence on the chromosome can be correlated with genetic map data. Such data are found, for example, in V. McKusick, *Mendelian Inheritance in Man* (available online through Johns Hopkins University Welch Medical Library). The relationship between genes and diseases that have been mapped to the same chromosomal region is then identified through linkage analysis (coinheritance of physically adjacent genes).

Next, it is necessary to determine the differences in the cDNA or genomic sequence between affected and unaffected individuals. If a mutation is observed in some or all of the affected individuals but not in any normal individuals, then the mutation is likely to be the causative agent of the disease.

With current resolution of physical mapping and genetic mapping techniques, a cDNA precisely localized to a chromosomal region associated with the disease could be one of between 50 and 500 potential causative genes. (This assumes 1 megabase mapping resolution and one gene per 20 kb).

5.2.4.9. Screening Assays for Drug Candidates

This invention encompasses methods of screening compounds to identify those that mimic the PRO polypeptide (agonists) or prevent the effect of the PRO polypeptide (antagonists). Screening assays for antagonist drug candidates are designed to identify compounds that bind or complex with the PRO polypeptide encoded by the genes identified herein, or otherwise interfere with the interaction of the encoded polypeptides with other cellular proteins. Such screening assays will include assays amenable to high-throughput screening of chemical libraries, making them particularly suitable for identifying small molecule drug candidates.

The assays can be performed in a variety of formats, including protein-protein binding assays, biochemical screening assays, immunoassays, and cell-based assays, which are well characterized in the art.

All assays for antagonists are common in that they call for contacting the drug candidate with a PRO polypeptide encoded by a nucleic acid identified herein under conditions and for a time sufficient to allow these two components to interact.

In binding assays, the interaction is binding and the complex formed can be isolated or detected in the reaction mixture. In a particular embodiment, the PRO polypeptide encoded by the gene identified herein or the drug candidate is immobilized on a solid phase, e.g., on a microtiter plate, by covalent or non-covalent attachments. Non-covalent attachment generally is accomplished by coating the solid surface with a solution of the PRO polypeptide and drying. Alternatively, an immobilized antibody, e.g., a monoclonal antibody, specific for the PRO polypeptide to be immobilized can be used to anchor it to a solid surface. The assay is performed by adding the non-immobilized component, which may be labeled by a detectable label, to the immobilized component, e.g., the coated surface containing the anchored component. When the reaction is complete, the non-reacted components are removed, e.g., by washing, and complexes anchored on the solid surface are detected. When the originally non-immobilized component carries a detectable label, the detection of label immobilized on the surface indicates that complexing occurred. Where the originally non-immobilized component does not carry a label, complexing can be detected, for example, by using a labeled antibody specifically binding the immobilized complex.

If the candidate compound interacts with but does not bind to a particular PRO polypeptide encoded by a gene identified herein, its interaction with that polypeptide can be assayed by methods well known for detecting protein-protein interactions. Such assays include traditional approaches, such as, e.g., cross-linking, co-immunoprecipitation, and co-purification through gradients or chromatographic columns. In addition, protein-protein interactions can be monitored by using a yeast-based genetic system described by Fields and co-workers (Fields and Song, *Nature (London)*, 340: 245–246 (1989); Chien et al., *Proc. Natl. Acad. Sci. USA*, 88: 9578–9582 (1991)) as disclosed by Chevray and Nathans, *Proc. Natl. Acad. Sci. USA*, 89: 5789–5793 (1991). Many transcriptional activators, such as yeast GAL4, consist of two physically discrete modular domains, one acting as the DNA-binding domain, the other one functioning as the transcription-activation domain. The yeast expression system described in the foregoing publications (generally referred to as the "two-hybrid system") takes advantage of this property, and employs two hybrid proteins, one in which the target protein is fused to the DNA-binding domain of GAL4, and another, in which candidate activating proteins are fused to the activation domain. The expression of a GAL1-lacZ reporter gene under control of a GAL4-activated promoter depends on reconstitution of GAL4 activity via protein-protein interaction. Colonies containing interacting polypeptides are detected with a chromogenic substrate for β-galactosidase. A complete kit (MATCHMAKER™) for identifying protein-protein interactions between two specific proteins using the two-hybrid technique is commercially available from Clontech. This system can also be extended to map protein domains involved in specific protein interactions as well as to pinpoint amino acid residues that are crucial for these interactions.

Compounds that interfere with the interaction of a gene encoding a PRO polypeptide identified herein and other intra- or extracellular components can be tested as follows: usually a reaction mixture is prepared containing the product of the gene and the intra- or extracellular component under conditions and for a time allowing for the interaction and binding of the two products. To test the ability of a candidate compound to inhibit binding, the reaction is run in the absence and in the presence of the test compound. In addition, a placebo may be added to a third reaction mixture, to serve as positive control. The binding (complex formation) between the test compound and the intra- or extracellular component present in the mixture is monitored as described hereinabove. The formation of a complex in the control reaction(s) but not in the reaction mixture containing the test compound indicates that the test compound interferes with the interaction of the test compound and its reaction partner.

If the PRO polypeptide has the ability to stimulate the proliferation of endothelial cells in the presence of the co-mitogen ConA, then one example of a screening method takes advantage of this ability. Specifically, in the proliferation assay, human umbilical vein endothelial cells are obtained and cultured in 96-well flat-bottomed culture plates (Costar, Cambridge, Mass.) and supplemented with a reaction mixture appropriate for facilitating proliferation of the cells, the mixture containing Con-A (Calbiochem, La Jolla, Calif.). Con-A and the compound to be screened are added and after incubation at 37° C., cultures are pulsed with $^3$-H-thymidine and harvested onto glass fiber filters (phD; Cambridge Technology, Watertown, Mass.). Mean $^3$-H-thymidine incorporation (cpm) of triplicate cultures is determined using a liquid scintillation counter (Beckman Instruments, Irvine, Calif.). Significant $^3$-(H)-thymidine incorporation indicates stimulation of endothelial cell proliferation.

To assay for antagonists, the assay described above is performed; however, in this assay the PRO polypeptide is added along with the compound to be screened and the ability of the compound to inhibit $^3$-(H)thymidine incorporation in the presence of the PRO polypeptide indicates that the compound is an antagonist to the PRO polypeptide. Alternatively, antagonists may be detected by combining the PRO polypeptide and a potential antagonist with membrane-bound PRO polypeptide receptors or recombinant receptors under appropriate conditions for a competitive inhibition assay. The PRO polypeptide can be labeled, such as by radioactivity, such that the number of PRO polypeptide molecules bound to the receptor can be used to determine the effectiveness of the potential antagonist. The gene encoding the receptor can be identified by numerous methods known to those of skill in the art, for example, ligand panning and FACS sorting. Coligan et al., *Current Protocols in Immun.*, 1(2): Chapter 5 (1991). Preferably, expression cloning is employed wherein polyadenylated RNA is prepared from a cell responsive to the PRO polypeptide and a cDNA library created from this RNA is divided into pools and used to transfect COS cells or other cells that are not responsive to the PRO polypeptide. Transfected cells that are grown on glass slides are exposed to the labeled PRO polypeptide. The PRO polypeptide can be labeled by a variety of means including iodination or inclusion of a recognition site for a site-specific protein kinase. Following fixation and incubation, the slides are subjected to autoradiographic analysis. Positive pools are identified and sub-pools are prepared and re-transfected using an interactive sub-pooling and re-screening process, eventually yielding a single clone that encodes the putative receptor.

As an alternative approach for receptor identification, the labeled PRO polypeptide can be photoaffinity-linked with cell membrane or extract preparations that express the receptor molecule. Cross-linked material is resolved by PAGE and exposed to X-ray film. The labeled complex containing the receptor can be excised, resolved into peptide fragments, and subjected to protein micro-sequencing. The amino acid sequence obtained from micro-sequencing would be used to design a set of degenerate oligonucleotide probes to screen a cDNA library to identify the gene encoding the putative receptor.

In another assay for antagonists, mammalian cells or a membrane preparation expressing the receptor would be incubated with the labeled PRO polypeptide in the presence of the candidate compound. The ability of the compound to enhance or block this interaction could then be measured.

The compositions useful in the treatment of cardiovascular, endothelial, and angiogenic disorders include, without limitation, antibodies, small organic and inorganic molecules, peptides, phosphopeptides, antisense and ribozyme molecules, triple-helix molecules, etc., that inhibit the expression and/or activity of the target gene product.

More specific examples of potential antagonists include an oligonucleotide that binds to the fusions of immunoglobulin with a PRO polypeptide, and, in particular, antibodies including, without limitation, poly- and monoclonal antibodies and antibody fragments, single-chain antibodies, anti-idiotypic antibodies, and chimeric or humanized versions of such antibodies or fragments, as well as human antibodies and antibody fragments. Alternatively, a potential antagonist may be a closely related protein, for example, a mutated form of the PRO polypeptide that recognizes the receptor but imparts no effect, thereby competitively inhibiting the action of the PRO polypeptide.

Another potential PRO polypeptide antagonist is an antisense RNA or DNA construct prepared using antisense technology, where, e.g., an antisense RNA or DNA molecule acts to block directly the translation of mRNA by hybridizing to targeted mRNA and preventing protein translation. Antisense technology can be used to control gene expression through triple-helix formation or antisense DNA or RNA, both of which methods are based on binding of a polynucleotide to DNA or RNA. For example, the 5' coding portion of the polynucleotide sequence, which encodes the mature PRO polypeptides herein, is used to design an antisense RNA oligonucleotide of from about 10 to 40 base pairs in length. A DNA oligonucleotide is designed to be complementary to a region of the gene involved in transcription (triple helix—see, Lee et al., *Nucl. Acids Res.*, 6:3073 (1979); Cooney et al., *Science*, 241: 456 (1988); Dervan et al., *Science*, 251:1360 (1991)), thereby preventing transcription and the production of the PRO polypeptide. A sequence "complementary" to a portion of an RNA, as referred to herein, means a sequence having sufficient complementarity to be able to hybridize with the RNA, forming a stable duplex; in the case of double-stranded antisense nucleic acids, a single strand of the duplex DNA may thus be tested, or triplex helix formation may be assayed. The ability to hybridize will depend on both the degree of complementarity and the length of the antisense nucleic acid. Generally, the longer the hybridizing nucleic acid, the more base mismatches with an RNA it may contain and still form a stable duplex (or triplex, as the case may be). One skilled in the art can ascertain a tolerable degree of mismatch by use of standard procedures to determine the melting point of the hybridized complex. The antisense RNA oligonucleotide hybridizes to the mRNA in vivo and blocks translation of the mRNA molecule into the PRO polypeptide (antisense—Okano, *Neurochem.*, 56:560 (1991); *Oligodeoxynucleotides as Antisense Inhibitors of Gene Expression* (CRC Press: Boca Raton, Fla., 1988).

The antisense oligonucleotides can be DNA or RNA or chimeric mixtures or derivatives or modified versions thereof, single-stranded or double-stranded. The oligonucleotide can be modified at the base moiety, sugar moiety, or phosphate backbone, for example, to improve stability of the molecule, hybridization, etc. The oligonucleotide may include other appended groups such as peptides (e.g., for targeting host cell receptors in vivo), or agents facilitating transport across the cell membrane (see, e.g., Letsinger, et al., 1989, *Proc. Natl. Acad. Sci. U.S.A.* 86:6553–6556; Lemaitre, et al, 1987, *Proc. Natl. Acad. Sci. U.S.A.* 84:648–652; PCT Publication No. WO88/09810, published Dec. 15, 1988) or the blood-brain barrier (see, e.g., PCT Publication No. WO89/10134, published Apr. 25, 1988), hybridization-triggered cleavage agents (see, e.g., Krol et al., 1988, *BioTechniques* 6:958–976) or intercalating agents (see, e.g., Zon, 1988, *Pharm. Res.* 5:539–549). To this end, the oligonucleotide may be conjugated to another molecule, e.g., a peptide, hybridization triggered cross-linking agent, transport agent, hybridization-triggered cleavage agent, etc.

The antisense oligonucleotide may comprise at least one modified base moiety which is selected from the group including but not limited to 5-fluorouracil, 5-bromouracil, 5-chlorouracil, 5-iodouracil, hypoxanthine, xanthine, 4-acetylcytosine, 5-(carboxyhydroxylmethyl) uracil, 5-carboxymethylaminomethyl-2-thiouridine, 5-carboxymethylaminomethyluracil, dihydrouracil, beta-D-galactosylqueosine, inosine, N6-isopentenyladenine, 1-methylguanine, 1-methylinosine, 2,2-dimethylguanine, 2-methyladenine, 2-methylguanine, 3-methylcytosine, 5-methylcytosine, N6-adenine, 7-methylguanine, 5-methylaminomethyluracil, 5-methoxyaminomethyl-2-thiouracil beta-D-mannosylqueosine, 5'-methoxycarboxymethyluracil, 5-methoxyuracil, 2-methylthio-N-6-isopentenyladenine, uracil-5-oxyacetic acid (v), wybutoxosine, pseudouracil, queosine, 2-thiocytosine, 5-methyl-2-thiouracil, 2-thiouracil, 4-thiouracil, 5-methyluracil, uracil-5-oxyacetic acid methylester, uracil-5-oxyacetic acid (v), 5-methyl-2-thiouracil, 3-(3-amino-3-N-2-carboxypropyl) uracil, (acp3)w, and 2,6-diaminopurine.

The antisense oligonucleotide may also comprise at least one modified sugar moiety selected from the group including but not limited to arabinose, 2-fluoroarabinose, xylulose, and hexose.

In yet another embodiment, the antisense oligonucleotide comprises at least one modified phosphate backbone selected from the group consisting of a phosphorothioate, a phosphorodithioate, a phosphoramidothioate, a phosphoramidate, a phosphordiamidate, a methylphosphonate, an alkyl phosphotriester, and a formacetal or analog thereof.

In yet another embodiment, the antisense oligonucleotide is an α-anomeric oligonucleotide. An α-anomeric oligonucleotide forms specific double-stranded hybrids with complementary RNA in which, contrary to the usual β-units, the strands run parallel to each other (Gautier, et al., 1987, *Nucl. Acids Res.* 15:6625–6641). The oligonucleotide is a 2'-0-methylribonucleotide (Inoue, et al., 1987, *Nucl. Acids Res.* 15:6131–6148), or a chimeric RNA-DNA analogue (Inoue, et al., 1987, *FEBS Lett.* 215:327–330).

Oligonucleotides of the invention may be synthesized by standard methods known in the art, e.g., by use of an automated DNA synthesizer (such as are commercially available from Biosearch, Applied Biosystems, etc.). As examples, phosphorothioate oligonucleotides may be synthesized by the method of Stein, et al. (1988, *Nucl Acids Res.* 16:3209), methylphosphonate oligonucleotides can be prepared by use of controlled pore glass polymer supports (Sarin, et al., 1988, *Proc. Natl. Acad. Sci. U.S.A.* 85:7448–7451), etc.

The oligonucleotides described above can also be delivered to cells such that the antisense RNA or DNA may be expressed in vivo to inhibit production of the PRO polypeptide. When antisense DNA is used, oligodeoxyribonucleotides derived from the translation-initiation site, e.g., between about −10 and +10 positions of the target gene nucleotide sequence, are preferred.

Antisense RNA or DNA molecules are generally at least about 5 bases in length, about 10 bases in length, about 15 bases in length, about 20 bases in length, about 25 bases in length, about 30 bases in length, about 35 bases in length, about 40 bases in length, about 45 bases in length, about 50 bases in length, about 55 bases in length, about 60 bases in length, about 65 bases in length, about 70 bases in length, about 75 bases in length, about 80 bases in length, about 85 bases in length, about 90 bases in length, about 95 bases in length, about 100 bases in length, or more.

Potential antagonists further include small molecules that bind to the active site, the receptor binding site, or growth factor or other relevant binding site of the PRO polypeptide, thereby blocking the normal biological activity of the PRO polypeptide. Examples of small molecules include, but are not limited to, small peptides or peptide-like molecules, preferably soluble peptides, and synthetic non-peptidyl organic or inorganic compounds.

Additional potential antagonists are ribozymes, which are enzymatic RNA molecules capable of catalyzing the specific cleavage of RNA. Ribozymes act by sequence-specific hybridization to the complementary target RNA, followed by endonucleolytic cleavage. Specific ribozyme cleavage sites within a potential RNA target can be identified by known techniques. For further details see, e.g., Rossi, *Current Biology*, 4: 469–471 (1994), and PCT publication No. WO 97/33551 (published Sep. 18, 1997).

While ribozymes that cleave mRNA at site specific recognition sequences can be used to destroy target gene mRNAs, the use of hammerhead ribozymes is preferred. Hammerhead ribozymes cleave mRNAs at locations dictated by flanking regions which form complementary base pairs with the target mRNA. The sole requirement is that the target mRNA have the following sequence of two bases: 5'-UG-3'. The construction and production of hammerhead ribozymes is well known in the art and is described more fully in Myers, 1995, *Molecular Biology and Biotechnology: A Comprehensive Desk Reference*, VCH Publishers, New York, (see especially FIG. 4, page 833) and in Haseloff and Gerlach, 1988, *Nature*, 334:585–591, which is incorporated herein by reference in its entirety.

Preferably the ribozyme is engineered so that the cleavage recognition site is located near the 5' end of the target gene mRNA, i.e., to increase efficiency and minimize the intracellular accumulation of non-functional mRNA transcripts.

The ribozymes of the present invention also include RNA endoribonucleases (hereinafter "Cech-type ribozymes") such as the one which occurs naturally in Tetrahymena thermophila (known as the IVS, or L-19 IVS RNA) and which has been extensively described by Thomas Cech and collaborators (Zaug, et al., 1984, *Science*, 224:574–578; Zaug and Cech, 1986, *Science*, 231:470–475; Zaug, et al., 1986, *Nature,* 324:429–433; published International patent application No. WO 88/04300 by University Patents Inc.; Been and Cech, 1986, *Cell,* 47:207–216). The Cech-type ribozymes have an eight base pair active site that hybridizes to a target RNA sequence whereafter cleavage of the target RNA takes place. The invention encompasses those Cech-type ribozymes that target eight base-pair active site sequences that are present in the target gene.

As in the antisense approach, the ribozymes can be composed of modified oligonucleotides (e.g., for improved stability, targeting, etc.) and should be delivered to cells that express the target gene in vivo. A preferred method of delivery involves using a DNA construct "encoding" the ribozyme under the control of a strong constitutive pol III or pol II promoter, so that transfected cells will produce sufficient quantities of the ribozyme to destroy endogenous target gene messages and inhibit translation. Because ribozymes, unlike antisense molecules, are catalytic, a lower intracellular concentration is required for efficiency.

Nucleic acid molecules in triple-helix formation used to inhibit transcription should be single-stranded and composed of deoxynucleotides. The base composition of these oligonucleotides is designed such that it promotes triple-helix formation via Hoogsteen base-pairing rules, which generally require sizeable stretches of purines or pyrimidines on one strand of a duplex. For further details see, e.g., PCT publication No. WO 97/33551, supra.

These small molecules can be identified by any one or more of the screening assays discussed hereinabove and/or by any other screening techniques well known for those skilled in the art.

5.2.4.10. Types of Cardiovascular, Endothelial, and Angiogenic Disorders to be Treated The PRO polypeptides, or agonists or antagonists thereto, that have activity in the cardiovascular, angiogenic, and endothelial assays described herein, and/or whose gene product has been found to be localized to the cardiovascular system, are likely to have therapeutic uses in a variety of cardiovascular, endothelial, and angiogenic disorders, including systemic disorders that affect vessels, such as diabetes mellitus. Their therapeutic utility could include diseases of the arteries, capillaries, veins, and/or lymphatics. Examples of treatments hereunder include treating muscle wasting disease, treating osteoporosis, aiding in implant fixation to stimulate the growth of cells around the implant and therefore facilitate its attachment to its intended site, increasing IGF stability in tissues or in serum, if applicable, and increasing binding to the IGF receptor (since IGF has been shown in vitro to enhance human marrow erythroid and granulocytic progenitor cell growth).

The PRO polypeptides or agonists or antagonists thereto may also be employed to stimulate erythropoiesis or granulopoiesis, to stimulate wound healing or tissue regeneration and associated therapies concerned with re-growth of tissue, such as connective tissue, skin, bone, cartilage, muscle, lung, or kidney, to promote angiogenesis, to stimulate or inhibit migration of endothelial cells, and to proliferate the growth of vascular smooth muscle and endothelial cell production. The increase in angiogenesis mediated by the PRO polypeptide or agonist would be beneficial to ischemic tissues and to collateral coronary development in the heart subsequent to coronary stenosis. Antagonists are used to inhibit the action of such polypeptides, for example, to limit the production of excess connective tissue during wound healing or pulmonary fibrosis if the PRO polypeptide promotes such production. This would include treatment of acute myocardial infarction and heart failure.

Moreover, the present invention provides the treatment of cardiac hypertrophy, regardless of the underlying cause, by administering a therapeutically effective dose of the PRO polypeptide, or agonist or antagonist thereto. If the objective is the treatment of human patients, the PRO polypeptide preferably is recombinant human PRO polypeptide (rhPRO polypeptide). The treatment for cardiac hypertrophy can be performed at any of its various stages, which may result from a variety of diverse pathologic conditions, including myocardial infarction, hypertension, hypertrophic cardiomyopathy, and valvular regurgitation. The treatment extends to all stages of the progression of cardiac hypertrophy, with or without structural damage of the heart muscle, regardless of the underlying cardiac disorder.

The decision of whether to use the molecule itself or an agonist thereof for any particular indication, as opposed to an antagonist to the molecule, would depend mainly on whether the molecule herein promotes cardiovascularization, genesis of endothelial cells, or angiogenesis or inhibits these conditions. For example, if the molecule promotes angiogenesis, an antagonist thereof would be useful for treatment of disorders where it is desired to limit or prevent angiogenesis. Examples of such disorders include vascular tumors such as haemangioma, tumor angiogenesis, neovascularization in the retina, choroid, or cornea, associated with diabetic retinopathy or premature infant retinopathy or macular degeneration and proliferative vitreoretinopathy, rheumatoid arthritis, Crohn's disease, atherosclerosis, ovarian hyperstimulation, psoriasis, endometriosis associated with neovascularization, restenosis subsequent to balloon angioplasty, scar tissue overproduction, for example, that seen in a keloid that forms after surgery, fibrosis after myocardial infarction, or fibrotic lesions associated with pulmonary fibrosis.

If, however, the molecule inhibits angiogenesis, it would be expected to be used directly for treatment of the above conditions.

On the other hand, if the molecule stimulates angiogenesis it would be used itself (or an agonist thereof) for indications where angiogenesis is desired such as peripheral vascular disease, hypertension, inflammatory vasculitides, Reynaud's disease and Reynaud's phenomenon, aneurysms, arterial restenosis, thrombophlebitis, lymphangitis, lymphedema, wound healing and tissue repair, ischemia reperfusion injury, angina, myocardial infarctions such as acute myocardial infarctions, chronic heart conditions, heart failure such as congestive heart failure, and osteoporosis.

If, however, the molecule inhibits angiogenesis, an antagonist thereof would be used for treatment of those conditions where angiogenesis is desired.

Specific types of diseases are described below, where the PRO polypeptide herein or agonists or antagonists thereof may serve as useful for vascular-related drug targeting or as therapeutic targets for the treatment or prevention of the disorders. Atherosclerosis is a disease characterized by accumulation of plaques of intimal thickening in arteries, due to accumulation of lipids, proliferation of smooth muscle cells, and formation of fibrous tissue within the arterial wall. The disease can affect large, medium, and small arteries in any organ. Changes in endothelial and vascular smooth muscle cell function are known to play an important role in modulating the accumulation and regression of these plaques.

Hypertension is characterized by raised vascular pressure in the systemic arterial, pulmonary arterial, or portal venous systems. Elevated pressure may result from or result in impaired endothelial function and/or vascular disease.

Inflammatory vasculitides include giant cell arteritis, Takayasu's arteritis, polyarteritis nodosa (including the microangiopathic form), Kawasaki's disease, microscopic polyangiitis, Wegener's granulomatosis, and a variety of infectious-related vascular disorders (including Henoch-Schonlein prupura). Altered endothelial cell function has been shown to be important in these diseases.

Reynaud's disease and Reynaud's phenomenon are characterized by intermittent abnormal impairment of the circulation through the extremities on exposure to cold. Altered endothelial cell function has been shown to be important in this disease.

Aneurysms are saccular or fusiform dilatations of the arterial or venous tree that are associated with altered endothelial cell and/or vascular smooth muscle cells.

Arterial restenosis (restenosis of the arterial wall) may occur following angioplasty as a result of alteration in the function and proliferation of endothelial and vascular smooth muscle cells.

Thrombophlebitis and lymphangitis are inflammatory disorders of veins and lymphatics, respectively, that may result from, and/or in, altered endothelial cell function. Similarly, lymphedema is a condition involving impaired lymphatic vessels resulting from endothelial cell function.

The family of benign and malignant vascular tumors are characterized by abnormal proliferation and growth of cellular elements of the vascular system. For example, lymphangiomas are benign tumors of the lymphatic system that are congenital, often cystic, malformations of the lymphatics that usually occur in newborns. Cystic tumors tend to grow into the adjacent tissue. Cystic tumors usually occur in the cervical and axillary region. They can also occur in the soft tissue of the extremities. The main symptoms are dilated, sometimes reticular, structured lymphatics and lymphocysts surrounded by connective tissue. Lymphangiomas are assumed to be caused by improperly connected embryonic lymphatics or their deficiency. The result is impaired local lymph drainage. Griener et al., *Lymphology*, 4: 140–144 (1971).

Another use for the PRO polypeptides herein or agonists or antagonists thereto is in the prevention of tumor angiogenesis, which involves vascularization of a tumor to enable it to growth and/or metastasize. This process is dependent on the growth of new blood vessels. Examples of neoplasms and related conditions that involve tumor angiogenesis include breast carcinomas, lung carcinomas, gastric carcinomas, esophageal carcinomas, colorectal carcinomas, liver carcinomas, ovarian carcinomas, thecomas, arrhenoblastomas, cervical carcinomas, endometrial carcinoma, endometrial hyperplasia, endometriosis, fibrosarcomas, choriocarcinoma, head and neck cancer, nasopharyngeal carcinoma, laryngeal carcinomas, hepatoblastoma, Kaposi's sarcoma, melanoma, skin carcinomas, hemangioma, cavernous hemangioma, hemangioblastoma, pancreas carcinomas, retinoblastoma, astrocytoma, glioblastoma, Schwannoma, oligodendroglioma, medulloblastoma, neuroblastomas, rhabdomyosarcoma, osteogenic sarcoma, leiomyosarcomas, urinary tract carcinomas, thyroid carcinomas, Wilm's tumor, renal cell carcinoma, prostate carcinoma, abnormal vascular proliferation associated with phakomatoses, edema (such as that associated with brain tumors), and Meigs' syndrome.

Age-related macular degeneration (AMD) is a leading cause of severe visual loss in the elderly population. The exudative form of AMD is characterized by choroidal neovascularization and retinal pigment epithelial cell detachment. Because choroidal neovascularization is associated with a dramatic worsening in prognosis, the PRO polypeptide or agonist or antagonist thereto is expected to be useful in reducing the severity of AMD.

Healing of trauma such as wound healing and tissue repair is also a targeted use for the PRO polypeptides herein or their agonists or antagonists. Formation and regression of new blood vessels is essential for tissue healing and repair. This category includes bone, cartilage, tendon, ligament, and/or nerve tissue growth or regeneration, as well as wound healing and tissue repair and replacement, and in the treatment of bums, incisions, and ulcers. A PRO polypeptide or agonist or antagonist thereof that induces cartilage and/or bone growth in circumstances where bone is not normally formed has application in the healing of bone fractures and cartilage damage or defects in humans and other animals. Such a preparation employing a PRO polypeptide or agonist or antagonist thereof may have prophylactic use in closed as well as open fracture reduction and also in the improved fixation of artificial joints. De novo bone formation induced by an osteogenic agent contributes to the repair of congenital, trauma-induced, or oncologic, resection-induced craniofacial defects, and also is useful in cosmetic plastic surgery.

PRO polypeptides or agonists or antagonists thereto may also be useful to promote better or faster closure of non-healing wounds, including without limitation pressure ulcers, ulcers associated with vascular insufficiency, surgical and traumatic wounds, and the like.

It is expected that a PRO polypeptide or agonist or antagonist thereto may also exhibit activity for generation or regeneration of other tissues, such as organs (including, for example, pancreas, liver, intestine, kidney, skin, or endothelium), muscle (smooth, skeletal, or cardiac), and vascular (including vascular endothelium) tissue, or for promoting the growth of cells comprising such tissues. Part of the desired effects may be by inhibition or modulation of fibrotic scarring to allow normal tissue to regenerate.

A PRO polypeptide herein or agonist or antagonist thereto may also be useful for gut protection or regeneration and treatment of lung or liver fibrosis, reperfusion injury in various tissues, and conditions resulting from systemic cytokine damage. Also, the PRO polypeptide or agonist or antagonist thereto may be useful for promoting or inhibiting differentiation of tissues described above from precursor tissues or cells, or for inhibiting the growth of tissues described above.

A PRO polypeptide or agonist or antagonist thereto may also be used in the treatment of periodontal diseases and in other tooth-repair processes. Such agents may provide an environment to attract bone-forming cells, stimulate growth of bone-forming cells, or induce differentiation of progenitors of bone-forming cells. A PRO polypeptide herein or an agonist or an antagonist thereto may also be useful in the treatment of osteoporosis or osteoarthritis, such as through stimulation of bone and/or cartilage repair or by blocking inflammation or processes of tissue destruction (collagenase activity, osteoclast activity, etc.) mediated by inflammatory processes, since blood vessels play an important role in the regulation of bone turnover and growth.

Another category of tissue regeneration activity that may be attributable to the PRO polypeptide herein or agonist or antagonist thereto is tendon/ligament formation. A protein that induces tendon/ligament-like tissue or other tissue formation in circumstances where such tissue is not normally formed has application in the healing of tendon or ligament tears, deformities, and other tendon or ligament defects in humans and other animals. Such a preparation may have prophylactic use in preventing damage to tendon or ligament tissue, as well as use in the improved fixation of tendon or ligament to bone or other tissues, and in repairing defects to tendon or ligament tissue. De novo tendon/ligament-like tissue formation induced by a composition of the PRO polypeptide herein or agonist or antagonist thereto contributes to the repair of congenital, trauma-induced, or other tendon or ligament defects of other origin, and is also useful in cosmetic plastic surgery for attachment or repair of tendons or ligaments. The compositions herein may provide an environment to attract tendon- or ligament-forming cells, stimulate growth of tendon- or ligament-forming cells, induce differentiation of progenitors of tendon- or ligament-forming cells, or induce growth of tendon/ligament cells or progenitors ex vivo for return in vivo to effect tissue repair. The compositions herein may also be useful in the treatment of tendinitis, carpal tunnel syndrome, and other tendon or ligament defects. The compositions may also include an appropriate matrix and/or sequestering agent as a carrier as is well known in the art.

The PRO polypeptide or its agonist or antagonist may also be useful for proliferation of neural cells and for regeneration of nerve and brain tissue, i.e., for the treatment of central and peripheral nervous system disease and neuropathies, as well as mechanical and traumatic disorders, that involve degeneration, death, or trauma to neural cells or nerve tissue. More specifically, a PRO polypeptide or its agonist or antagonist may be used in the treatment of diseases of the peripheral nervous system, such as peripheral nerve injuries, peripheral neuropathy and localized neuropathies, and central nervous system diseases, such as Alzheimer's, Parkinson's disease, Huntington's disease, amyotrophic lateral sclerosis, and Shy-Drager syndrome. Further conditions that may be treated in accordance with the present invention include mechanical and traumatic disorders, such as spinal cord disorders, head trauma, and cerebrovascular diseases such as stroke. Peripheral neuropathies resulting from chemotherapy or other medical therapies may also be treatable using a PRO polypeptide herein or agonist or antagonist thereto.

Ischemia-reperfusion injury is another indication. Endothelial cell dysfunction may be important in both the initiation of, and in regulation of the sequelae of events that occur following ischemia-reperfusion injury.

Rheumatoid arthritis is a further indication. Blood vessel growth and targeting of inflammatory cells through the vasculature is an important component in the pathogenesis of rheumatoid and sero-negative forms of arthritis.

A PRO polypeptide or its agonist or antagonist may also be administered prophylactically to patients with cardiac hypertrophy, to prevent the progression of the condition, and avoid sudden death, including death of asymptomatic patients. Such preventative therapy is particularly warranted in the case of patients diagnosed with massive left ventricular cardiac hypertrophy (a maximal wall thickness of 35 mm or more in adults, or a comparable value in children), or in instances when the hemodynamic burden on the heart is particularly strong.

A PRO polypeptide or its agonist or antagonist may also be useful in the management of atrial fibrillation, which develops in a substantial portion of patients diagnosed with hypertrophic cardiomyopathy.

Further indications include angina, myocardial infarctions such as acute myocardial infarctions, and heart failure such as congestive heart failure. Additional non-neoplastic conditions include psoriasis, diabetic and other proliferative retinopathies including retinopathy of prematurity, retrolental fibroplasia, neovascular glaucoma, thyroid hyperplasias (including Grave's disease), corneal and other tissue transplantation, chronic inflammation, lung inflammation, nephrotic syndrome, preeclampsia, ascites, pericardial effusion (such as that associated with pericarditis), and pleural effusion.

In view of the above, the PRO polypeptides or agonists or antagonists thereof described herein, which are shown to alter or impact endothelial cell function, proliferation, and/or form, are likely to play an important role in the etiology and pathogenesis of many or all of the disorders noted above, and as such can serve as therapeutic targets to augment or inhibit these processes or for vascular-related drug targeting in these disorders.

5.2.4.11. Administration Protocols, Schedules, Doses, and Formulations

The molecules herein and agonists and antagonists thereto are pharmaceutically useful as a prophylactic and therapeutic agent for various disorders and diseases as set forth above.

Therapeutic compositions of the PRO polypeptides or agonists or antagonists are prepared for storage by mixing the desired molecule having the appropriate degree of purity with optional pharmaceutically acceptable carriers, excipients, or stabilizers (*Remington's Pharmaceutical Sciences*, 16th edition, Osol, A. ed. (1980)), in the form of lyophilized formulations or aqueous solutions. Acceptable carriers, excipients, or stabilizers are nontoxic to recipients at the dosages and concentrations employed, and include buffers such as phosphate, citrate, and other organic acids; antioxidants including ascorbic acid and methionine; preservatives (such as octadecyldimethylbenzyl ammonium chloride; hexamethonium chloride; benzalkonium chloride, benzethonium chloride; phenol, butyl or benzyl alcohol; alkyl parabens such as methyl or propyl paraben; catechol; resorcinol; cyclohexanol; 3-pentanol; and m-cresol); low molecular weight (less than about 10 residues) polypeptides; proteins, such as serum albumin, gelatin, or immunoglobulins; hydrophilic polymers such as polyvinylpyrrolidone; amino acids such as glycine, glutamine, asparagine, histidine, arginine, or lysine; monosaccharides, disaccharides, and other carbohydrates including glucose, mannose, ordextrins; chelating agents such as EDTA; sugars such as sucrose, mannitol, trehalose or sorbitol; salt-forming counter-ions such as sodium; metal complexes (e.g., Zn-protein complexes); and/or non-ionic surfactants such as TWEEN™, PLURONICS™ or polyethylene glycol (PEG).

Additional examples of such carriers include ion exchangers, alumina, aluminum stearate, lecithin, serum proteins, such as human serum albumin, buffer substances such as phosphates, glycine, sorbic acid, potassium sorbate, partial glyceride mixtures of saturated vegetable fatty acids, water, salts, or electrolytes such as protamine sulfate, disodium hydrogen phosphate, potassium hydrogen phosphate, sodium chloride, zinc salts, colloidal silica, magnesium trisilicate, polyvinyl pyrrolidone, cellulose-based substances, and polyethylene glycol. Carriers for topical or gel-based forms of agonist or antagonist include polysaccharides such as sodium carboxymethylcellulose or methylcellulose, polyvinylpyrrolidone, polyacrylates, polyoxyethylene-polyoxypropylene-block polymers, polyethylene glycol, and wood wax alcohols. For all administrations, conventional depot forms are suitably used. Such forms include, for example, microcapsules, nano-capsules, liposomes, plasters, inhalation forms, nose sprays, sublingual tablets, and sustained-release preparations. The PRO polypeptides or agonists or antagonists will typically be formulated in such vehicles at a concentration of about 0.1 mg/ml to 100 mg/ml.

Another formulation comprises incorporating a PRO polypeptide or agonist or antagonist thereof into formed articles. Such articles can be used in modulating endothelial cell growth and angiogenesis. In addition, tumor invasion and metastasis may be modulated with these articles.

PRO polypeptides or agonists or antagonists to be used for in vivo administration must be sterile. This is readily accomplished by filtration through sterile filtration membranes, prior to or following lyophilization and reconstitution. PRO polypeptides ordinarily will be stored in lyophilized form or in solution if administered systemically. If in lyophilized form, the PRO polypeptide or agonist or antagonist thereto is typically formulated in combination with other ingredients for reconstitution with an appropriate diluent at the time for use. An example of a liquid formulation of a PRO polypeptide or agonist or antagonist is a sterile, clear, colorless unpreserved solution filled in a single-dose vial for subcutaneous injection. Preserved pharmaceutical compositions suitable for repeated use may contain, for example, depending mainly on the indication and type of polypeptide:

a) PRO polypeptide or agonist or antagonist thereto;
b) a buffer capable of maintaining the pH in a range of maximum stability of the polypeptide or other molecule in solution, preferably about 4–8;
c) a detergent/surfactant primarily to stabilize the polypeptide or molecule against agitation-induced aggregation;
d) an isotonifier;
e) a preservative selected from the group of phenol, benzyl alcohol and a benzethonium halide, e.g., chloride; and
f) water.

If the detergent employed is non-ionic, it may, for example, be polysorbates (e.g., POLYSORBATE™ (TWEEN™) 20, 80, etc.) or poloxamers (e.g., POLOXAMER™ 188). The use of non-ionic surfactants permits the formulation to be exposed to shear surface stresses without causing denaturation of the polypeptide. Further, such surfactant-containing formulations may be employed in aerosol devices such as those used in a pulmonary dosing, and needleless jet injector guns (see, e.g., EP 257,956).

An isotonifier may be present to ensure isotonicity of a liquid composition of the PRO polypeptide or agonist or antagonist thereto, and includes polyhydric sugar alcohols, preferably trihydric or higher sugar alcohols, such as glycerin, erythritol, arabitol, xylitol, sorbitol, and mannitol. These sugar alcohols can be used alone or in combination. Alternatively, sodium chloride or other appropriate inorganic salts may be used to render the solutions isotonic.

The buffer may, for example, be an acetate, citrate, succinate, or phosphate buffer depending on the pH desired. The pH of one type of liquid formulation of this invention is buffered in the range of about 4 to 8, preferably about physiological pH.

The preservatives phenol, benzyl alcohol and benzethonium halides, e.g., chloride, are known antimicrobial agents that may be employed.

Therapeutic PRO polypeptide compositions generally are placed into a container having a sterile access port, for example, an intravenous solution bag or vial having a stopper pierceable by a hypodermic injection needle. The formulations are preferably administered as repeated intravenous (i.v.), subcutaneous (s.c.), or intramuscular (i.m.) injections, or as aerosol formulations suitable for intranasal or intrapulmonary delivery (for intrapulmonary delivery see, e.g., EP 257,956).

PRO polypeptides can also be administered in the form of sustained-released preparations. Suitable examples of sustained-release preparations include semipermeable matrices of solid hydrophobic polymers containing the protein, which matrices are in the form of shaped articles, e.g., films, or microcapsules. Examples of sustained-release matrices include polyesters, hydrogels (e.g., poly(2-hydroxyethyl-methacrylate) as described by Langer et al., *J. Biomed. Mater. Res.*, 15: 167–277 (1981) and Langer, *Chem. Tech*, 12: 98–105 (1982) or poly(vinylalcohol)), polylactides (U.S. Pat. No. 3,773,919, EP 58,481), copolymers of L-glutamic acid and gamma ethyl-L-glutamate(Sidman et al., *Biopolymers*, 22: 547–556(1983)), non-degradableethylene-vinyl acetate (Langer et al., supra), degradable lactic acid-glycolic acid copolymers such as the Lupron Depot™ (injectable microspheres composed of lactic acid-glycolic acid copolymer and leuprolide acetate), and poly-D-(−)-3-hydroxybutyric acid (EP 133,988).

While polymers such as ethylene-vinyl acetate and lactic acid-glycolic acid enable release of molecules for over 100 days, certain hydrogels release proteins for shorter time periods. When encapsulated proteins remain in the body for a long time, they may denature or aggregate as a result of exposure to moisture at 37° C., resulting in a loss of biological activity and possible changes in immunogenicity. Rational strategies can be devised for protein stabilization depending on the mechanism involved. For example, if the aggregation mechanism is discovered to be intermolecular S—S bond formation through thio-disulfide interchange, stabilization may be achieved by modifying sulfhydryl residues, lyophilizing from acidic solutions, controlling moisture content, using appropriate additives, and developing specific polymer matrix compositions.

Sustained-release PRO polypeptide compositions also include liposomally entrapped PRO polypeptides. Liposomes containing the PRO polypeptide are prepared by methods known per se: DE 3,218,121; Epstein et al., *Proc. Natl. Acad. Sci. USA*, 82: 3688–3692 (1985); Hwang et al, *Proc. Natl. Acad. Sci. USA*, 77: 4030–4034 (1980); EP 52,322; EP 36,676; EP 88,046; EP 143,949; EP 142,641; Japanese patent application 83-118008; U.S. Pat. Nos. 4,485,045 and 4,544,545; and EP 102,324. Ordinarily the liposomes are of the small (about 200–800 Angstroms) unilamellar type in which the lipid content is greater than about 30 mol. % cholesterol, the selected proportion being adjusted for the optimal therapy.

The therapeutically effective dose of a PRO polypeptide or agonist or antagonist thereto will, of course, vary depending on such factors as the pathological condition to be treated (including prevention), the method of administration, the type of compound being used for treatment, any co-therapy involved, the patient's age, weight, general medical condition, medical history, etc., and its determination is well within the skill of a practicing physician. Accordingly, it will be necessary for the therapist to titer the dosage and modify the route of administration as required to obtain the maximal therapeutic effect. If the PRO polypeptide has a narrow host range, for the treatment of human patients formulations comprising human PRO polypeptide, more preferably native-sequence human PRO polypeptide, are preferred. The clinician will administer the PRO polypeptide until a dosage is reached that achieves the desired effect for treatment of the condition in question. For example, if the objective is the treatment of CHF, the amount would be one that inhibits the progressive cardiac hypertrophy associated with this condition. The progress of this therapy is easily monitored by echo cardiography. Similarly, in patients with hypertrophic cardiomyopathy, the PRO polypeptide can be administered on an empirical basis.

With the above guidelines, the effective dose generally is within the range of from about 0.001 to about 1.0 mg/kg, more preferably about 0.01–1.0 mg/kg, most preferably about 0.01–0.1 mg/kg.

For non-oral use in treating human adult hypertension, it is advantageous to administer the PRO polypeptide in the form of an injection at about 0.01 to 50 mg, preferably about 0.05 to 20 mg, most preferably 1 to 20 mg, per kg body weight, 1 to 3 times daily by intravenous injection. For oral administration, a molecule based on the PRO polypeptide is preferably administered at about 5 mg to 1 g, preferably about 10 to 100 mg, per kg body weight, 1 to 3 times daily. It should be appreciated that endotoxin contamination should be kept minimally at a safe level, for example, less than 0.5 ng/mg protein. Moreover, for human administration, the formulations preferably meet sterility, pyrogenicity, general safety, and purity as required by FDA Office and Biologics standards.

The dosage regimen of a pharmaceutical composition containing the PRO polypeptide to be used in tissue regeneration will be determined by the attending physician considering various factors that modify the action of the polypeptides, e.g., amount of tissue weight desired to be formed, the site of damage, the condition of the damaged tissue, the size of a wound, type of damaged tissue (e.g., bone), the patient's age, sex, and diet, the severity of any infection, time of administration, and other clinical factors. The dosage may vary with the type of matrix used in the reconstitution and with inclusion of other proteins in the pharmaceutical composition. For example, the addition of other known growth factors, such as IGF-I, to the final composition may also affect the dosage. Progress can be monitored by periodic assessment of tissue/bone growth and/or repair, for example, X-rays, histomorphometric determinations, and tetracycline labeling.

The route of PRO polypeptide or antagonist or agonist administration is in accord with known methods, e.g., by injection or infusion by intravenous, intramuscular, intracerebral, intraperitoneal, intracerobrospinal, subcutaneous, intraocular, intraarticular, intrasynovial, intrathecal, oral, topical, or inhalation routes, or by sustained-release systems as noted below. The PRO polypeptide or agonist or antagonists thereof also are suitably administered by intratumoral, peritumoral, intralesional, or perilesional routes, to exert local as well as systemic therapeutic effects. The intraperitoneal route is expected to be particularly useful, for example, in the treatment of ovarian tumors.

If a peptide or small molecule is employed as an antagonist or agonist, it is preferably administered orally or nonorally in the form of a liquid or solid to mammals.

Examples of pharmacologically acceptable salts of molecules that form salts and are useful hereunder include alkali metal salts (e.g., sodium salt, potassium salt), alkaline earth metal salts (e.g., calcium salt, magnesium salt), ammonium salts, organic base salts (e.g., pyridine salt, triethylamine salt), inorganic acid salts (e.g., hydrochloride, sulfate, nitrate), and salts of organic acid (e.g., acetate, oxalate, p-toluenesulfonate).

For compositions herein that are useful for bone, cartilage, tendon, or ligament regeneration, the therapeutic method includes administering the composition topically, systemically, or locally as an implant or device. When administered, the therapeutic composition for use is in a pyrogen-free, physiologically acceptable form. Further, the composition may desirably be encapsulated or injected in a viscous form for delivery to the site of bone, cartilage, or tissue damage. Topical administration may be suitable for wound healing and tissue repair. Preferably, for bone and/or cartilage formation, the composition would include a matrix capable of delivering the protein-containing composition to the site of bone and/or cartilage damage, providing a structure for the developing bone and cartilage and preferably capable of being resorbed into the body. Such matrices may be formed of materials presently in use for other implanted medical applications.

The choice of matrix material is based on biocompatibility, biodegradability, mechanical properties, cosmetic appearance, and interface properties. The particular application of the compositions will define the appropriate formulation. Potential matrices for the compositions may be biodegradable and chemically defined calcium sulfate, tricalcium phosphate, hydroxyapatite, polylactic acid, polyglycolic acid, and polyanhydrides. Other potential materials are biodegradable and biologically well-defined, such as bone or dermal collagen. Further matrices are comprised of pure proteins or extracellular matrix components. Other potential matrices are nonbiodegradable and chemically defined, such as sintered hydroxyapatite, bioglass, aluminates, or other ceramics. Matrices may be comprised of combinations of any of the above-mentioned types of material, such as polylactic acid and hydroxyapatite or collagen and tricalcium phosphate. The bioceramics may be altered in composition, such as in calcium-aluminate-phosphate and processing to alter pore size, particle size, particle shape, and biodegradability.

One specific embodiment is a 50:50 (mole weight) copolymer of lactic acid and glycolic acid in the form of porous particles having diameters ranging from 150 to 800 microns. In some applications, it will be useful to utilize a sequestering agent, such as carboxymethyl cellulose or autologous blood clot, to prevent the polypeptide compositions from disassociating from the matrix.

One suitable family of sequestering agents is cellulosic materials such as alkylcelluloses (including hydroxyalkylcelluloses), including methylcellulose, ethylcellulose, hydroxyethylcellulose, hydroxypropylcellulose, hydroxypropylmethylcellulose, and carboxymethylcellulose, one preferred being cationic salts of carboxymethylcellulose (CMC). Other preferred sequestering agents include hyaluronic acid, sodium alginate, poly(ethylene glycol), polyoxyethylene oxide, carboxyvinyl polymer, and poly(vinyl alcohol). The amount of sequestering agent useful herein is 0.5–20 wt %, preferably 1–10 wt %, based on total formulation weight, which represents the amount necessary to prevent desorption of the polypeptide (or its antagonist) from the polymer matrix and to provide appropriate handling of the composition, yet not so much that the progenitor cells are prevented from infiltrating the matrix, thereby providing the polypeptide (or its antagonist) the opportunity to assist the osteogenic activity of the progenitor cells.

5.2.4.12. Combination Therapies

The effectiveness of the PRO polypeptide or an agonist or antagonist thereof in preventing or treating the disorder in question may be improved by administering the active agent serially or in combination with another agent that is effective for those purposes, either in the same composition or as separate compositions.

For example, for treatment of cardiac hypertrophy, PRO polypeptide therapy can be combined with the administration of inhibitors of known cardiac myocyte hypertrophy factors, e.g., inhibitors of α-adrenergic agonists such as phenylephrine; endothelin-1 inhibitors such as BOSENTAN™ and MOXONODIN™; inhibitors to CT-1 (U.S. Pat. No. 5,679,545); inhibitors to LIF; ACE inhibitors; des-aspartate-angiotensin I inhibitors (U.S. Pat. No. 5,773,415), and angiotensin II inhibitors.

For treatment of cardiac hypertrophy associated with hypertension, the PRO polypeptide can be administered in combination with β-adrenergic receptor blocking agents, e.g., propranolol, timolol, tertalolol, carteolol, nadolol, betaxolol, penbutolol, acetobutolol, atenolol, metoprolol, or carvedilol; ACE inhibitors, e.g, quinapril, captopril, enalapril, ramipril, benazepril, fosinopril, or lisinopril; diuretics, e.g., chlorothiazide, hydrochlorothiazide, hydroflumethazide, methylchlothiazide, benzthiazide, dichlorphenamide, acetazolamide, or indapamide; and/or calcium channel blockers, e.g., diltiazem, nifedipine, verapamil, or nicardipine. Pharmaceutical compositions comprising the therapeutic agents identified herein by their generic names are commercially available, and are to be administered following the manufacturers' instructions for dosage, administration, adverse effects, contraindications, etc. See, e.g., *Physicians' Desk Reference* (Medical Economics Data Production Co.: Montvale, N.J., 1997), 51 th Edition.

Preferred candidates for combination therapy in the treatment of hypertrophic cardiomyopathy are β-adrenergic-blocking drugs (e.g., propranolol, timolol, tertalolol, carteolol, nadolol, betaxolol, penbutolol, acetobutolol, atenolol, metoprolol, or carvedilol), verapamil, difedipine, or diltiazem. Treatment of hypertrophy associated with high blood pressure may require the use of antihypertensive drug therapy, using calcium channel blockers, e.g., diltiazem, nifedipine, verapamil, or nicardipine; p-adrenergic blocking agents; diuretics, e.g., chlorothiazide, hydrochlorothiazide, hydroflumethazide, methylchlothiazide, benzthiazide, dichlorphenamide, acetazolamide, or indapamide; and/or ACE-inhibitors, e.g., quinapril, captopril, enalapril, ramipril, benazepril, fosinopril, or lisinopril.

For other indications, PRO polypeptides or their agonists or antagonists may be combined with other agents beneficial to the treatment of the bone and/or cartilage defect, wound, or tissue in question. These agents include various growth factors such as EGF, PDGF, TGF-α or TGF-β, IGF, FGF, and CTGF.

In addition, PRO polypeptides or their agonists or antagonists used to treat cancer may be combined with cytotoxic, chemotherapeutic, or growth-inhibitory agents as identified above. Also, for cancer treatment, the PRO polypeptide or agonist or antagonist thereof is suitably administered serially or in combination with radiological treatments, whether involving irradiation or administration of radioactive substances.

The effective amounts of the therapeutic agents administered in combination with the PRO polypeptide or agonist or antagonist thereof will be at the physician's or veterinarian's discretion. Dosage administration and adjustment is done to achieve maximal management of the conditions to be treated. For example, for treating hypertension, these amounts ideally take into account use of diuretics or digitalis, and conditions such as hyper- or hypotension, renal impairment, etc. The dose will additionally depend on such factors as the type of the therapeutic agent to be used and the specific patient being treated. Typically, the amount employed will be the same dose as that used, if the given therapeutic agent is administered without the PRO polypeptide.

5.2.4.13. Articles of Manufacture

An article of manufacture such as a kit containing the PRO polypeptide or agonists or antagonists thereof useful for the diagnosis or treatment of the disorders described above comprises at least a container and a label. Suitable containers include, for example, bottles, vials, syringes, and test tubes. The containers may be formed from a variety of materials such as glass or plastic. The container holds a composition that is effective for diagnosing or treating the condition and may have a sterile access port (for example, the container may be an intravenous solution bag or a vial having a stopper pierceable by a hypodermic injection needle). The active agent in the composition is the PRO polypeptide or an agonist or antagonist thereto. The label on, or associated with, the container indicates that the composition is used for diagnosing or treating the condition of choice. The article of manufacture may further comprise a second container comprising a pharmaceutically-acceptable buffer, such as phosphate-buffered saline, Ringer's solution, and dextrose solution. It may further include other materials desirable from a commercial and user standpoint, including other buffers, diluents, filters, needles, syringes, and package inserts with instructions for use. The article of manufacture may also comprise a second or third container with another active agent as described above.

5.2.5. Antibodies

Some of the most promising drug candidates according to the present invention are antibodies and antibody fragments that may inhibit the production or the gene product of the genes identified herein and/or reduce the activity of the gene products.

5.2.5.1. Polyclonal Antibodies

Methods of preparing polyclonal antibodies are known to the skilled artisan. Polyclonal antibodies can be raised in a mammal, for example, by one or more injections of an immunizing agent and, if desired, an adjuvant. Typically, the immunizing agent and/or adjuvant will be injected in the mammal by multiple subcutaneous or intraperitoneal injections. The immunizing agent may include the PRO polypeptide or a fusion protein thereof. It may be useful to conjugate the immunizing agent to a protein known to be immunogenic in the mammal being immunized. Examples of such immunogenic proteins include, but are not limited to, keyhole limpet hemocyanin, serum albumin, bovine thyroglobulin, and soybean trypsin inhibitor. Examples of adjuvants that may be employed include Freund's complete adjuvant and MPL-TDM adjuvant (monophosphoryl Lipid A or synthetic trehalose dicorynomycolate). The immunization protocol may be selected by one skilled in the art without undue experimentation.

5.2.5.2. Monoclonal Antibodies

The anti-PRO antibodies may, alternatively, be monoclonal antibodies. Monoclonal antibodies may be prepared using hybridoma methods, such as those described by Kohler and Milstein, *Nature,* 256:495 (1975). In a hybridoma method, a mouse, hamster, or other appropriate host animal is typically immunized with an immunizing agent to elicit lymphocytes that produce or are capable of producing antibodies that will specifically bind to the immunizing agent. Alternatively, the lymphocytes may be immunized in vitro.

The immunizing agent will typically include the PRO polypeptide or a fusion protein thereof Generally, either peripheral blood lymphocytes ("PBLs") are used if cells of human origin are desired, or spleen cells or lymph node cells are used if non-human mammalian sources are desired. The lymphocytes are then fused with an immortalized cell line using a suitable fusing agent, such as polyethylene glycol, to form a hybridoma cell. Goding, *Monoclonal Antibodies: Principles and Practice* (New York: Academic Press, 1986), pp.59–103. Immortalized cell lines are usually transformed mammalian cells, particularly myeloma cells of rodent, bovine, and human origin. Usually, rat or mouse myeloma cell lines are employed. The hybrtidoma cells may be cultured in a suitable culture medium that preferably contains one or more substances that inhibit the growth or survival of the unfused, immortalized cells. For example, if the parental cells lack the enzyme hypoxanthine guanine phosphoribosyl transferase (HGPRT or HPRT), the culture medium for the hybridomas typically will include hypoxanthine, aminopterin, and thymidine ("HAT medium"), which substances prevent the growth of HGPRT-deficient cells.

Preferred immortalized cell lines are those that fuse efficiently, support stable high-level expression of antibody by the selected antibody-producing cells, and are sensitive to a medium such as HAT medium. More preferred immortalized cell lines are murine myeloma lines, which can be obtained, for instance, from the Salk Institute Cell Distribution Center, San Diego, Calif. and the American Type Culture Collection, Manassas, Va. Human myeloma and mouse-human heteromyeloma cell lines also have been described for the production of human monoclonal antibodies. Kozbor, *J. Immunol.*, 133:3001 (1984); Brodeur et al, *Monoclonal Antibody Production Techniques and Applications* (Marcel Dekker, Inc.: New York, 1987) pp. 51–63.

The culture medium in which the hybridoma cells are cultured can then be assayed for the presence of monoclonal antibodies directed against the PRO polypeptide. Preferably, the binding specificity of monoclonal antibodies produced by the hybridoma cells is determined by immunoprecipitation or by an in vitro binding assay, such as radioimmunoassay (RIA) or enzyme-linked immunoabsorbent assay (ELISA). Such techniques and assays are known in the art. The binding affinity of the monoclonal antibody can, for example, be determined by the Scatchard analysis of Munson and Pollard, *Anal. Biochem.*, 107:220 (1980).

After the desired hybridoma cells are identified, the clones may be subcloned by limiting dilution procedures and grown by standard methods. Goding, supra. Suitable culture media for this purpose include, for example, Dulbecco's Modified Eagle's Medium and RPMI-1640 medium. Alternatively, the hybridoma cells may be grown in vivo as ascites in a mammal.

The monoclonal antibodies secreted by the subclones may be isolated or purified from the culture medium or ascites fluid by conventional immunoglobulin purification procedures such as, for example, protein A-Sepharose, hydroxylapatite chromatography, gel electrophoresis, dialysis, or affinity chromatography.

The monoclonal antibodies may also be made by recombinant DNA methods, such as those described in U.S. Pat. No. 4,816,567. DNA encoding the monoclonal antibodies of the invention can be readily isolated and sequenced using conventional procedures (e.g., by using oligonucleotide probes that are capable of binding specifically to genes encoding the heavy and light chains of murine antibodies). The hybridoma cells of the invention serve as a preferred source of such DNA. Once isolated, the DNA may be placed into expression vectors, which are then transfected into host cells such as simian COS cells, Chinese hamster ovary (CHO) cells, or myeloma cells that do not otherwise produce immunoglobulin protein, to obtain the synthesis of monoclonal antibodies in the recombinant host cells. The DNA also may be modified, for example, by substituting the coding sequence for human heavy- and light-chain constant domains in place of the homologous murine sequences (U.S. Pat. No. 4,816,567; Morrison et al., supra) or by covalently joining to the immunoglobulin coding sequence all or part of the coding sequence for a non-immunoglobulin polypeptide. Such a non-immunoglobulin polypeptide can be substituted for the constant domains of an antibody of the invention, or can be substituted for the variable domains of one antigen-combining site of an antibody of the invention to create a chimeric bivalent antibody.

The antibodies may be monovalent antibodies. Methods for preparing monovalent antibodies are well known in the art. For example, one method involves recombinant expression of immunoglobulin light chain and modified heavy chain. The heavy chain is truncated generally at any point in the Fe region so as to prevent heavy-chain crosslinking. Alternatively, the relevant cysteine residues are substituted with another amino acid residue or are deleted so as to prevent crosslinking.

In vitro methods are also suitable for preparing monovalent antibodies. Digestion of antibodies to produce fragments thereof, particularly Fab fragments, can be accomplished using routine techniques known in the art.

5.2.5.3. Human and Humanized Antibodies

The anti-PRO antibodies may further comprise humanized antibodies or human antibodies. Humanized forms of non-human (e.g., murine) antibodies are chimeric immunoglobulins, immunoglobulin chains, or fragments thereof (such as Fv, Fab, Fab', F(ab')$_2$ or other antigen-binding subsequences of antibodies) that contain minimal sequence derived from non-human immunoglobulin. Humanized antibodies include human immunoglobulins (recipient antibody) in which residues from a CDR of the recipient are replaced by residues from a CDR of a non-human species (donor antibody) such as mouse, rat, or rabbit having the desired specificity, affinity, and capacity. In some instances, Fv framework residues of the human immunoglobulin are replaced by corresponding non-human residues. Humanized antibodies may also comprise residues that are found neither in the recipient antibody nor in the imported CDR or framework sequences. In general, the humanized antibody will comprise substantially all of at least one, and typically two, variable domains, in which all or substantially all of the CDR regions correspond to those of a non-human immunoglobulin, and all or substantially all of the FR regions are those of a human immunoglobulin consensus sequence. The humanized antibody preferably also will comprise at least a portion of an immunoglobulin constant region (Fe), typically that of a human immunoglobulin. Jones et al., *Nature*, 321: 522–525 (1986); Riechmann et al., *Nature*, 332: 323–329 (1988); Presta, *Curr. Op. Struct. Biol.*, 2:593–596 (1992).

Methods for humanizing non-human antibodies are well known in the art. Generally, a humanized antibody has one or more amino acid residues introduced into it from a source that is non-human. These non-human amino acid residues are often referred to as "import" residues, which are typically taken from an "import" variable domain. Humanization can be essentially performed following the method of Winter and co-workers (Jones et al., *Nature*, 321:522–525 (1986); Riechmann et al, *Nature*, 332:323–327(1988); Verhoeyen et al., *Science*, 239: 1534–1536 (1988)), by substituting rodent CDRs or CDR sequences for the corresponding sequences of a human antibody. Accordingly, such "humanized" antibodies are chimeric antibodies (U.S. Pat. No. 4,816,567), wherein substantially less than an intact human variable domain has been substituted by the corresponding sequence from a non-human species. In practice, humanized antibodies are typically human antibodies in which some CDR residues and possibly some FR residues are substituted by residues from analogous sites in rodent antibodies.

Human antibodies can also be produced using various techniques known in the art, including phage display libraries. Hoogenboom and Winter, *J. Mol. Biol.*, 227: 381 (1991); Marks et al., *J. Mol. Biol.*, 222: 581 (1991). The techniques of Cole et al. and Boerner et al. are also available for the preparation of human monoclonal antibodies. Cole et al., *Monoclonal Antibodies and Cancer Therapy*, Alan R. Liss, p.77 (1985) and Boerner et al., *J. Immunol.*, 147(1): 86–95 (1991). Similarly, human antibodies can be made by introducing human immunoglobulin loci into transgenic animals, e.g., mice in which the endogenous immunoglobulin genes have been partially or completely inactivated. Upon challenge, human antibody production is observed that closely resembles that seen in humans in all respects, including gene rearrangement, assembly, and antibody repertoire. This approach is described, for example, in U.S. Pat. Nos. 5,545,807; 5,545,806; 5,569,825; 5,625,126; 5,633,425; and 5,661,016, and in the following scientific publications: Marks et al., *Bio/Technology*, 10: 779–783 (1992); Lonberg et al., *Nature*, 368: 856–859 (1994); Morrison, *Nature*, 368: 812–813 (1994); Fishwild et al., *Nature Biotechnology*, 14: 845–851 (1996); Neuberger, *Nature Biotechnology*, 14: 826 (1996); Lonberg and Huszar, *Intern. Rev. Immunol.*, 13: 65–93 (1995).

5.2.5.4. Bispecific Antibodies

Bispecific antibodies are monoclonal, preferably human or humanized, antibodies that have binding specificities for at least two different antigens. In the present case, one of the binding specificities is for the PRO polypeptide, the other one is for any other antigen, and preferably for a cell-surface protein or receptor or receptor subunit.

Methods for making bispecific antibodies are known in the art. Traditionally, the recombinant production of bispecific antibodies is based on the co-expression of two immunoglobulin heavy-chain/light-chain pairs, where the two heavy chains have different specificities. Milstein and Cuello, *Nature*, 305: 537–539 (1983). Because of the random assortment of immunoglobulin heavy and light chains, these hybridomas (quadromas) produce a potential mixture of ten different antibody molecules, of which only one has the correct bispecific structure. The purification of the correct molecule is usually accomplished by affinity chromatography steps. Similar procedures are disclosed in WO 93/08829, published May 13, 1993, and in Traunecker et al., *EMBO J.*, 10: 3655–3659 (1991).

Antibody variable domains with the desired binding specificities (antibody-antigen combining sites) can be fused to immunoglobulin constant-domain sequences. The fusion preferably is with an immunoglobulin heavy-chain constant domain, comprising at least part of the hinge, CH2, and CH3 regions. It is preferred to have the first heavy-chain constant region (CH1) containing the site necessary for light-chain binding present in at least one of the fusions. DNAs encoding the immunoglobulin heavy-chain fusions and, if desired, the immunoglobulin light chain, are inserted into separate expression vectors, and are co-transfected into a suitable host organism. For further details of generating bispecific antibodies, see, for example, Suresh et al., *Methods in Enzymology*, 121: 210 (1986).

5.2.5.5. Heteroconjugate Antibodies

Heteroconjugate antibodies are composed of two covalently joined antibodies. Such antibodies have, for example, been proposed to target immune-system cells to unwanted cells (U.S. Pat. No. 4,676,980), and for treatment of HIV infection. WO 91/00360; WO 92/200373; EP 03089. It is contemplated that the antibodies may be prepared in vitro using known methods in synthetic protein chemistry, including those involving crosslinking agents. For example, immunotoxins may be constructed using a disulfide-exchange reaction or by forming a thioether bond. Examples of suitable reagents for this purpose include iminothiolate and methyl-4-mercaptobutyrimidate and those disclosed, for example, in U.S. Pat. No. 4,676,980.

5.2.5.6. Effector Function Engineering

It may be desirable to modify the antibody of the invention with respect to effector function, so as to enhance, e.g., the effectiveness of the antibody in treating cancer. For example, cysteine residue(s) may be introduced into the Fc region, thereby allowing interchain disulfide bond formation in this region. The homodimeric antibody thus generated may have improved internalization capability and/or increased complement-mediated cell killing and antibody-dependent cellular cytotoxicity (ADCC). See, Caron et al., *J. Exp. Med.*, 176: 1191–1195 (1992) and Shopes, *J. Immunol.*, 148: 2918–2922 (1992). Homodimeric antibodies with enhanced anti-tumor activity may also be prepared using heterobifunctional cross-linkers as described in Wolff et al., *Cancer Research*, 53: 2560–2565 (1993). Alternatively, an antibody can be engineered that has dual Fc regions and may thereby have enhanced complement lysis and ADCC capabilities. See, Stevenson et al., *Anti-Cancer Drug Design*, 3: 219–230 (1989).

5.2.5.7. Immunoconjugates

The invention also pertains to immunoconjugates comprising an antibody conjugated to a cytotoxic agent such as a chemotherapeutic agent, toxin (e.g., an enzymatically active toxin of bacterial, fungal, plant, or animal origin, or fragments thereof), or a radioactive isotope (i.e., a radioconjugate).

Chemotherapeutic agents useful in the generation of such immunoconjugates have been described above.

Enzymatically active toxins and fragments thereof that can be used include diphtheria A chain, nonbinding active fragments of diphtheria toxin, exotoxin A chain (from *Pseudomonas aeruginosa*), ricin A chain, abrin A chain, modeccin A chain, alpha-sarcin, *Aleurites fordii* proteins, dianthin proteins, *Phytolaca americana* proteins (PAPI, PAPII, and PAP-S), momordica charantia inhibitor, curcin, crotin, sapaonaria officinalis inhibitor, gelonin, mitogellin, restrictocin, phenomycin, enomycin, and the tricothecenes. A variety of radionuclides are available for the production of radioconjugated antibodies. Examples include $^{212}$Bi, $^{131}$I, $^{131}$In, $^{90}$Y, and $^{186}$Re.

Conjugates of the antibody and cytotoxic agent are made using a variety of bifunctional protein-coupling agents such as N-succinimidyl-3-(2-pyridyldithiol) propionate (SPDP), iminothiolane (IT), bifunctional derivatives of imidoesters (such as dimethyl adipimidate HCl), active esters (such as disuccinimidyl suberate), aldehydes (such as glutaraldehyde), bis-azido compounds (such as bis (p-azidobenzoyl) hexanediamine), bis-diazonium derivatives (such as bis-(p-diazoniumbenzoyl)-ethylenediamine), diisocyanates (such as tolyene 2,6-diisocyanate), and bis-active fluorine compounds (such as 1,5-difluoro-2,4-dinitrobenzene). For example, a ricin immunotoxin can be prepared as described in Vitetta et al., *Science*, 238: 1098 (1987). Carbon-14-labeled 1-isothiocyanatobenzyl-3-methyldiethylene triaminepentaacetic acid (MX-DTPA) is an exemplary chelating agent for conjugation of radionucleotide to the antibody. See, WO94/11026.

In another embodiment, the antibody may be conjugated to a "receptor" (such as streptavidin) for utilization in tumor pretargeting wherein the antibody-receptor conjugate is administered to the patient, followed by removal of unbound conjugate from the circulation using a clearing agent and then administration of a "ligand" (e.g., avidin) that is conjugated to a cytotoxic agent (e.g., a radionucleotide).

5.2.5.8. Immunoliposomes

The antibodies disclosed herein may also be formulated as immunoliposomes. Liposomes containing the antibody are prepared by methods known in the art, such as described in Epstein et al., *Proc. Natl. Acad. Sci. USA*, 82: 3688 (1985); Hwang et al., *Proc. Natl. Acad. Sci. USA*, 77: 4030 (1980); and U.S. Pat. Nos. 4,485,045 and 4,544,545. Liposomes with enhanced circulation time are disclosed in U.S. Pat. No. 5,013,556.

Particularly useful liposomes can be generated by the reverse-phase evaporation method with a lipid composition comprising phosphatidylcholine, cholesterol, and PEG-derivatized phosphatidylethanolamine (PEG-PE). Liposomes are extruded through filters of defined pore size to yield liposomes with the desired diameter. Fab' fragments of the antibody of the present invention can be conjugated to the liposomes as described in Martin et al., *J. Biol. Chem.*, 257: 286–288 (1982) via a disulfide-interchange reaction. A chemotherapeutic agent (such as Doxorubicin) is optionally contained within the liposome. See, Gabizon et al., *J. National Cancer Inst.*, 81(19): 1484 (1989).

5.2.5.9. Pharmaceutical Compositions of Antibodies

Antibodies specifically binding a PRO polypeptide identified herein, as well as other molecules identified by the screening assays disclosed hereinbefore, can be administered for the treatment of various disorders as noted above and below in the form of pharmaceutical compositions.

If the PRO polypeptide is intracellular and whole antibodies are used as inhibitors, internalizing antibodies are preferred. However, lipofections or liposomes can also be used to deliver the antibody, or an antibody fragment, into cells. Where antibody fragments are used, the smallest inhibitory fragment that specifically binds to the binding domain of the target protein is preferred. For example, based upon the variable-region sequences of an antibody, peptide molecules can be designed that retain the ability to bind the target protein sequence. Such peptides can be synthesized chemically and/or produced by recombinant DNA technology. See, e.g., Marasco et al, *Proc. Natl. Acad. Sci. USA*, 90: 7889–7893 (1993).

The formulation herein may also contain more than one active compound as necessary for the particular indication being treated, preferably those with complementary activities that do not adversely affect each other. Alternatively, or in addition, the composition may comprise an agent that enhances its function, such as, for example, a cytotoxic agent, cytokine, chemotherapeutic agent, or growth-inhibitory agent. Such molecules are suitably present in combination in amounts that are effective for the purpose intended.

The active ingredients may also be entrapped in microcapsules prepared, for example, by coacervation techniques or by interfacial polymerization, for example, hydroxymethylcellulose or gelatin-microcapsules and poly-(methylmethacylate) microcapsules, respectively, in colloidal drug delivery systems (for example, liposomes, albumin microspheres, microemulsions, nano-particles, and nanocapsules) or in macroemulsions. Such techniques are disclosed in Remington's *Pharmaceutical Sciences*, supra.

The formulations to be used for in vivo administration must be sterile. This is readily accomplished by filtration through sterile filtration membranes.

Sustained-release preparations may be prepared. Suitable examples of sustained-release preparations include semipermeable matrices of solid hydrophobic polymers containing the antibody, which matrices are in the form of shaped articles, e.g., films, or microcapsules. Examples of sustained-release matrices include polyesters, hydrogels (for example, poly(2-hydroxyethyl-methacrylate), or poly(vinylalcohol)), polylactides (U.S. Pat. No. 3,773,919), copolymers of L-glutamic acid and γ ethyl-L-glutamate, non-degradable ethylene-vinyl acetate, degradable lactic acid-glycolic acid copolymers such as the LUPRON DEPOT (injectable microspheres composed of lactic acid-glycolic acid copolymer and leuprolide acetate), and poly-D-(–)-3-hydroxybutyric acid. While polymers such as ethylene-vinyl acetate and lactic acid-glycolic acid enable release of molecules for over 100 days, certain hydrogels release proteins for shorter time periods. When encapsulated antibodies remain in the body for a long time, they may denature or aggregate as a result of exposure to moisture at 37° C., resulting in a loss of biological activity and possible changes in immunogenicity. Rational strategies can be devised for stabilization depending on the mechanism involved. For example, if the aggregation mechanism is discovered to be intermolecular S—S bond formation through thio-disulfide interchange, stabilization may be achieved by modifying sulfhydryl residues, lyophilizing from acidic solutions, controlling moisture content, using appropriate additives, and developing specific polymer matrix compositions.

5.2.5.10. Methods of Treatment Using the Antibody

It is contemplated that the antibodies to a PRO polypeptide may be used to treat various cardiovascular, endothelial, and angiogenic conditions as noted above.

The antibodies are administered to a mammal, preferably a human, in accord with known methods, such as intravenous administration as a bolus or by continuous infusion over a period of time, by intramuscular, intraperitoneal, intracerobrospinal, subcutaneous, intra-articular, intrasynovial, intrathecal, oral, topical, or inhalation routes. Intravenous administration of the antibody is preferred.

Other therapeutic regimens may be combined with the administration of the antibodies of the instant invention as noted above. For example, if the antibodies are to treat cancer, the patient to be treated with such antibodies may also receive radiation therapy. Alternatively, or in addition, a chemotherapeutic agent may be administered to the patient. Preparation and dosing schedules for such chemotherapeutic agents may be used according to manufacturers' instructions or as determined empirically by the skilled practitioner. Preparation and dosing schedules for such chemotherapy are also described in *Chemotherapy Service*, Ed., M. C. Perry (Williams & Wilkins: Baltimore, Md., 1992). The chemotherapeutic agent may precede, or follow administration of the antibody, or may be given simultaneously therewith. The antibody may be combined with an anti-estrogen compound such as tamoxifen or EVISTA™ or an anti-progesterone such as onapristone (see, EP 616812) in dosages known for such molecules.

If the antibodies are used for treating cancer, it may be desirable also to administer antibodies against other tumor-associated antigens, such as antibodies that bind to one or more of the ErbB2, EGFR, ErbB3, ErbB4, or VEGF receptor(s). These also include the agents set forth above.

Also, the antibody is suitably administered serially or in combination with radiological treatments, whether involving irradiation or administration of radioactive substances. Alternatively, or in addition, two or more antibodies binding the same or two or more different antigens disclosed herein may be co-administered to the patient. Sometimes, it may be beneficial also to administer one or more cytokines to the patient. In a preferred embodiment, the antibodies herein are co-administered with a growth-inhibitory agent. For example, the growth-inhibitory agent may be administered first, followed by an antibody of the present invention. However, simultaneous administration or administration of the antibody of the present invention first is also contemplated. Suitable dosages for the growth-inhibitory agent are those presently used and may be lowered due to the combined action (synergy) of the growth-inhibitory agent and the antibody herein.

In one embodiment, vascularization of tumors is attacked in combination therapy. The anti-PRO polypeptide antibody and another antibody (e.g., anti-VEGF) are administered to tumor-bearing patients at therapeutically effective doses as determined, for example, by observing necrosis of the tumor or its metastatic foci, if any. This therapy is continued until such time as no further beneficial effect is observed or clinical examination shows no trace of the tumor or any metastatic foci. Then TNF is administered, alone or in combination with an auxiliary agent such as alpha-, beta-, or gamma-interferon, anti-HER2 antibody, heregulin, anti-heregulin antibody, D-factor, interleukin-1 (IL-1), interleukin-2 (IL-2), granulocyte-macrophage colony stimulating factor (GM-CSF), or agents that promote microvascular coagulation in tumors, such as anti-protein C antibody, anti-protein S antibody, or C4b binding protein (see, WO 91/01753, published Feb. 21, 1991), or heat or radiation.

Since the auxiliary agents will vary in their effectiveness, it is desirable to compare their impact on the tumor by matrix screening in conventional fashion. The administration of anti-PRO polypeptide antibody and TNF is repeated until the desired clinical effect is achieved. Alternatively, the anti-PRO polypeptide antibody is administered together with TNF and, optionally, auxiliary agent(s). In instances where solid tumors are found in the limbs or in other locations susceptible to isolation from the general circulation, the therapeutic agents described herein are administered to the isolated tumor or organ. In other embodiments, a FGF or PDGF antagonist, such as an anti-FGF or an anti-PDGF neutralizing antibody, is administered to the patient in conjunction with the anti-PRO polypeptide antibody. Treatment with anti-PRO polypeptide antibodies preferably may be suspended during periods of wound healing or desirable neovascularization.

For the prevention or treatment of cardiovascular, endothelial, and angiogenic disorder, the appropriate dosage of an antibody herein will depend on the type of disorder to be treated, as defined above, the severity and course of the disease, whether the antibody is administered for preventive or therapeutic purposes, previous therapy, the patient's clinical history and response to the antibody, and the discretion of the attending physician. The antibody is suitably administered to the patient at one time or over a series of treatments.

For example, depending on the type and severity of the disorder, about 1 µg/kg to 50 mg/kg (e.g., 0.1–20 mg/kg) of antibody is an initial candidate dosage for administration to the patient, whether, for example, by one or more separate administrations, or by continuous infusion. A typical daily or weekly dosage might range from about 1 µg/kg to 100 mg/kg or more, depending on the factors mentioned above. For repeated administrations over several days or longer, depending on the condition, the treatment is repeated or sustained until a desired suppression of disorder symptoms occurs. However, other dosage regimens may be useful. The progress of this therapy is easily monitored by conventional techniques and assays, including, for example, radiographic tumor imaging.

5.2.5.11. Articles of Manufacture with Antibodies

An article of manufacture containing a container with the antibody and a label is also provided. Such articles are described above, wherein the active agent is an anti-PRO antibody.

5.2.5.12. Diagnosis and Prognosis of Tumors Using Antibodies

If the indication for which the antibodies are used is cancer, while cell-surface proteins, such as growth receptors over expressed in certain tumors, are excellent targets for drug candidates or tumor (e.g., cancer) treatment, the same proteins along with PRO polypeptides find additional use in the diagnosis and prognosis of tumors. For example, antibodies directed against the PRO polypeptides may be used as tumor diagnostics or prognostics.

For example, antibodies, including antibody fragments, can be used qualitatively or quantitatively to detect the expression of genes including the gene encoding the PRO polypeptide. The antibody preferably is equipped with a detectable, e.g., fluorescent label, and binding can be monitored by light microscopy, flow cytometry, fluorimetry, or other techniques known in the art. Such binding assays are performed essentially as described above.

In situ detection of antibody binding to the marker gene products can be performed, for example, by immunofluorescence or immunoelectron microscopy. For this purpose, a histological specimen is removed from the patient, and a labeled antibody is applied to it, preferably by overlaying the antibody on a biological sample. This procedure also allows for determining the distribution of the marker gene product in the tissue examined. It will be apparent to those skilled in the art that a wide variety of histological methods are readily available for in situ detection.

The following Examples are offered for illustrative purposes only, and are not intended to limit the scope of the present invention in any way.

The disclosures of all patent and literature references cited in the present specification are hereby incorporated by reference in their entirety.

6. EXAMPLES

Commercially available reagents referred to in the Examples were used according to manufacturer's instructions unless otherwise indicated. The source of those cells identified in the following Examples, and throughout the specification, by ATCC accession numbers is the American Type Culture Collection, Manassas, Va. Unless otherwise noted, the present invention uses standard procedures of recombinant DNA technology, such as those described hereinabove and in the following textbooks: Sambrook et al., supra; Ausubel et al., *Current Protocols in Molecular Biology* (Green Publishing Associates and Wiley Interscience, N.Y., 1989); Innis et al., *PCR Protocols: A Guide to Methods and Applications* (Academic Press, Inc.: N.Y., 1990); Harlow et al., *Antibodies: A Laboratory Manual* (Cold Spring Harbor Press: Cold Spring Harbor, 1988); Gait, *Oligonucle-*

*otide Synthesis* (IRL Press: Oxford, 1984); Freshney, *Animal Cell Culture*, 1987; Coligan et al., *Current Protocols in Immunology*, 1991.

6.1. Example 1

Extracellular Domain Homology Screening to Identify Novel Polypeptides and cDNA Encoding Therefor The extracellular domain (ECD) sequences (including the secretion signal sequence, if any) from about 950 known secreted proteins from the Swiss-Prot public database were used to search EST databases. The EST databases included public databases (e.g., Dayhoff, GenBank), and proprietary databases (e.g. LIFESEQ®, Incyte Pharmaceuticals, Palo Alto, Calif.). The search was performed using the computer program BLAST or BLAST-2 (Altschul et al., *Methods in Enzymology*, 266:460–480 (1996)) as a comparison of the ECD protein sequences to a 6 frame translation of the EST sequences. Those comparisons with a BLAST score of 70 (or in some cases, 90) or greater that did not encode known proteins were clustered and assembled into consensus DNA sequences with the program "phrap" (Phil Green, University of Washington, Seattle, Wash.).

Using this extracellular domain homology screen, consensus DNA sequences were assembled relative to the other identified EST sequences using phrap. In addition, the consensus DNA sequences obtained were often (but not always) extended using repeated cycles of BLAST or BLAST-2 and phrap to extend the consensus sequence as far as possible using the sources of EST sequences discussed above.

Based upon the consensus sequences obtained as described above, oligonucleotides were then synthesized and used to identify by PCR a cDNA library that contained the sequence of interest and for use as probes to isolate a clone of the full-length coding sequence for a PRO polypeptide. Forward and reverse PCR primers generally range from 20 to 30 nucleotides and are often designed to give a PCR product of about 100–1000 bp in length. The probe sequences are typically 40–55 bp in length. In some cases, additional oligonucleotides are synthesized when the consensus sequence is greater than about 1–1.5 kbp. In order to screen several libraries for a full-length clone, DNA from the libraries was screened by PCR amplification, as per Ausubel et al., *Current Protocols in Molecular Biology*, with the PCR primer pair. A positive library was then used to isolate clones encoding the gene of interest using the probe oligonucleotide and one of the primer pairs.

The cDNA libraries used to isolate the cDNA clones were constructed by standard methods using commercially available reagents such as those from Invitrogen, San Diego, Calif. The cDNA was primed with oligo dT containing a NotI site, linked with blunt to SalI hemikinased adaptors, cleaved with NotI, sized appropriately by gel electrophoresis, and cloned in a defined orientation into a suitable cloning vector (such as pRKB or pRKD; pRK5B is a precursor of pRK5D that does not contain the SfiI site; see, Holmes et al., *Science*, 253:1278–1280 (1991)) in the unique XhoI and NotI sites.

6.2. Example 2

Isolation of cDNA Clones by Amylase Screening 6.2.1. Preparation of Oligo dT Primed cDNA Library mRNA was isolated from a human tissue of interest using reagents and protocols from Invitrogen, San Diego, Calif. (Fast Track 2). This RNA was used to generate an oligo dT primed cDNA library in the vector pRK5D using reagents and protocols from Life Technologies, Gaithersburg, Md. (Super Script Plasmid System). In this procedure, the double stranded cDNA was sized to greater than 1000 bp and the SalI/NotI Tinkered cDNA was cloned into XhoI/NotI cleaved vector. pRK5D is a cloning vector that has an sp6 transcription initiation site followed by an SfiI restriction enzyme site preceding the XhoI/NotI cDNA cloning sites.

6.2.2. Preparation of Random Primed cDNA Library

A secondary cDNA library was generated in order to preferentially represent the 5' ends of the primary cDNA clones. Sp6 RNA was generated from the primary library (described above), and this RNA was used to generate a random primed cDNA library in the vector pSST-AMY.0 using reagents and protocols from Life Technologies (Super Script Plasmid System, referenced above). In this procedure the double stranded cDNA was sized to 500–1000 bp, Tinkered with blunt to NotI adaptors, cleaved with SfiI, and cloned into SfiI/NotI cleaved vector. pSST-AMY.0 is a cloning vector that has a yeast alcohol dehydrogenase promoter preceding the cDNA cloning sites and the mouse amylase sequence (the mature sequence without the secretion signal) followed by the yeast alcohol dehydrogenase terminator, after the cloning sites. Thus, cDNAs cloned into this vector that are fused in frame with amylase sequence will lead to the secretion of amylase from appropriately transfected yeast colonies.

6.2.3. Transformation and Detection

DNA from the library described in paragraph 2 above was chilled on ice to which was added electrocompetent DH10B bacteria (Life Technologies, 20 ml). The bacteria and vector mixture was then electroporated as recommended by the manufacturer. Subsequently, SOC media (Life Technologies, 1 ml) was added and the mixture was incubated at 37° C. for 30 minutes. The transformants were then plated onto 20 standard 150 mm LB plates containing ampicillin and incubated for 16 hours (37° C.). Positive colonies were scraped off the plates and the DNA was isolated from the bacterial pellet using standard protocols, e.g., CsCl-gradient. The purified DNA was then carried on to the yeast protocols below.

The yeast methods were divided into three categories: (1) Transformation of yeast with the plasmid/cDNA combined vector; (2) Detection and isolation of yeast clones secreting amylase; and (3) PCR amplification of the insert directly from the yeast colony and purification of the DNA for sequencing and further analysis.

The yeast strain used was HD56–5A (ATCC-90785). This strain has the following genotype: MAT alpha, ura3–52, leu2–3, leu2–112, his3–11, his3–15, MAL$^+$, SUC$^+$, GAL$^+$. Preferably, yeast mutants can be employed that have deficient post-translational pathways. Such mutants may have translocation deficient alleles in sec71, sec72, sec62, with truncated sec71 being most preferred. Alternatively, antagonists (including antisense nucleotides and/or ligands) which interfere with the normal operation of these genes, other proteins implicated in this post translation pathway (e.g, SEC61p, SEC72p, SEC62p, SEC63p, TDJ1p or SSA1p–4p) or the complex formation of these proteins may also be preferably employed in combination with the amylase-expressing yeast.

Transformation was performed based on the protocol outlined by Gietz et al., *Nucl. Acid. Res.*, 20:1425 (1992). Transformed cells were then inoculated from agar into YEPD complex media broth (100 ml) and grown overnight at 30° C. The YEPD broth was prepared as described in Kaiser et al., *Methods in Yeast Genetics*, Cold Spring Harbor Press, Cold Spring Harbor, N.Y., p. 207 (1994). The overnight culture was then diluted to about $2\times10^6$ cells/ml (approx. $OD_{600}$=0.1) into fresh YEPD broth (500 ml) and regrown to $1\times10^7$ cells/ml (approx. $OD_{600}$=0.4–0.5).

The cells were then harvested and prepared for transformation by transfer into GS3 rotor bottles in a Sorval GS3 rotor at 5,000 rpm for 5 minutes, the supernatant discarded, and then resuspended into sterile water, and centrifuged again in 50 ml falcon tubes at 3,500 rpm in a Beckman GS-6KR centrifuge. The supernatant was discarded and the cells were subsequently washed with LiAc/TE (10 ml, 10 mM Tris-HCl, 1 mM EDTA pH 7.5, 100 mM $Li_2OOCCH_3$), and resuspended into LiAc/TE (2.5 ml).

Transformation took place by mixing the prepared cells (100 µl) with freshly denatured single stranded salmon testes DNA (Lofstrand Labs, Gaithersburg, Md.) and transforming DNA (1 µg, vol. <10 µl) in microfuge tubes. The mixture was mixed briefly by vortexing, then 40% PEG/TE (600 µl, 40% polyethylene glycol-4000, 10 mM Tris-HCl, 1 mM EDTA, 100 mM $Li_2OOCCH_3$, pH 7.5) was added. This mixture was gently mixed and incubated at 30° C. while agitating for 30 minutes. The cells were then heat shocked at 42° C. for 15 minutes, and the reaction vessel centrifuged in a microfuge at 12,000 rpm for 5–10 seconds, decanted and resuspended into TE (500 µl, 10 mM Tris-HCl, 1 mM EDTA pH 7.5) followed by recentrifugation. The cells were then diluted into TE (1 ml) and aliquots (200 µl) were spread onto the selective media previously prepared in 150 mm growth plates (VWR).

Alternatively, instead of multiple small reactions, the transformation was performed using a single, large scale reaction, wherein reagent amounts were scaled up accordingly.

The selective media used was a synthetic complete dextrose agar lacking uracil (SCD-Ura) prepared as described in Kaiser et al., *Methods in Yeast Genetics*, Cold Spring Harbor Press, Cold Spring Harbor, N.Y., p. 208–210 (1994). Transfonmants were grown at 30° C. for 2–3 days.

The detection of colonies secreting amylase was performed by including red starch in the selective growth media. Starch was coupled to the red dye (Reactive Red-120, Sigma) as per the procedure described by Biely et al., *Anal. Biochem.*, 172:176–179 (1988). The coupled starch was incorporated into the SCD-Ura agar plates at a final concentration of 0.15% (w/v), and was buffered with potassium phosphate to a pH of 7.0 (50–100 mM final concentration).

The positive colonies were picked and streaked across fresh selective media (onto 150 mm plates) in order to obtain well isolated and identifiable single colonies. Well isolated single colonies positive for amylase secretion were detected by direct incorporation of red starch into buffered SCD-Ura agar. Positive colonies were determined by their ability to break down starch resulting in a clear halo around the positive colony visualized directly.

6.2.4. Isolation of DNA by PCR Amplification

When a positive colony was isolated, a portion of it was picked by a toothpick and diluted into sterile water (30 µl) in a 96 well plate. At this time, the positive colonies were either frozen and stored for subsequent analysis or immediately amplified. An aliquot of cells (5 µl) was used as a template for the PCR reaction in a 25 µl volume containing: 0.5 µl Klentaq (Clontech, Palo Alto, Calif.); 4.0 µl 10 mM dNTP's (Perkin Elmer-Cetus); 2.5 µl Kentaq buffer (Clontech); 0.25 µl forward oligo 1; 0.25 µl reverse oligo 2; 12.5 µl distilled water. The sequence of the forward oligonucleotide was:

5'-TGTAAAACGACGGCCAGT <u>TAAATAGACCTGCAATTATTAATCT</u>-3' (SEQ ID NO:382)

The sequence of reverse oligonucleotide 2 was:
5'-CAGGAAACAGCTATGACC <u>ACCTGCACACCTGCAAATCCATT</u>-3' (SEQ ID NO:383)
PCR was then performed as follows:

| a. | | Denature | 92° C., | 5 minutes |
|---|---|---|---|---|
| b. | 3 cycles of: | Denature | 92° C., | 30 seconds |
| | | Anneal | 59° C., | 30 seconds |
| | | Extend | 72° C., | 60 seconds |
| c. | 3 cycles of: | Denature | 92° C., | 30 seconds |
| | | Anneal | 57° C., | 30 seconds |
| | | Extend | 72° C., | 60 seconds |
| d. | 25 cycles of: | Denature | 92° C., | 30 seconds |
| | | Anneal | 55° C., | 30 seconds |
| | | Extend | 72° C., | 60 seconds |
| e. | | Hold | 4° C. | |

The underlined regions of the oligonucleotides annealed to the ADH promoter region and the amylase region, respectively, and amplified a 307 bp region from vector pSST-AMY.0 when no insert was present. Typically, the first 18 nucleotides of the 5' end of these oligonucleotides contained annealing sites for the sequencing primers. Thus, the total product of the PCR reaction from an empty vector was 343 bp. However, signal sequence-fused cDNA resulted in considerably longer nucleotide sequences.

Following the PCR, an aliquot of the reaction (5 µl) was examined by agarose gel electrophoresis in a 1% agarose gel using a Tris-Borate-EDTA (TBE) buffering system as described by Sambrook et al., supra. Clones resulting in a single strong PCR product larger than 400 bp were further analyzed by DNA sequencing after purification with a 96 Qiaquick PCR clean-up column (Qiagen Inc., Chatsworth, Calif.).

6.3. Example 3

Isolation of cDNA Clones Using Signal Algorithm Analysis

Various polypeptide-encoding nucleic acid sequences were identified by applying a proprietary signal sequence finding algorithm developed by Genentech, Inc., (South San Francisco, Calif.) upon ESTs as well as clustered and assembled EST fragments from public (e.g., GenBank) and/or private (LIFESEQ®, Incyte Pharmaceuticals, Inc., Palo Alto, Calif.) databases. The signal sequence algorithm computes a secretion signal score based on the character of the DNA nucleotides surrounding the first and optionally the second methionine codon(s) (ATG) at the 5'-end of the sequence or sequence fragment under consideration. The nucleotides following the first ATG must code for at least 35 unambiguous amino acids without any stop codons. If the first ATG has the required amino acids, the second is not examined. If neither meets the requirement, the candidate sequence is not scored. In order to determine whether the EST sequence contains an authentic signal sequence, the DNA and corresponding amino acid sequences surrounding the ATG codon are scored using a set of seven sensors (evaluation parameters) known to be associated with secretion signals. Use of this algorithm resulted in the identification of numerous polypeptide-encoding nucleic acid sequences.

6.4. Example 4

Isolation of cDNA Clones Encoding Human PRO Polypeptides

Using the techniques described in Examples 1 to 3 above, numerous full-length cDNA clones were identified as encoding PRO polypeptides as disclosed herein. These cDNAs were then deposited under the terms of the Budapest Treaty with the American Type Culture Collection, 10801 University Blvd., Manassas, Va. 20110–2209, USA (ATCC) as shown in Table 7 below.

TABLE 7

| Material | ATCC Dep. No. | Deposit Date |
|---|---|---|
| 23330-1390 | 209775 | Apr. 14, 1998 |
| 23339-1130 | 209282 | Sep. 18, 1997 |
| 26846-1397 | 203406 | Oct. 27, 1998 |
| 26847-1395 | 209772 | Apr. 14, 1998 |
| 27865-1091 | 209296 | Sep. 23, 1997 |
| 30868-1156 | 1437-PTA | Mar. 2, 2000 |
| 30871-1157 | 209380 | Oct. 16, 1997 |
| 32286-1191 | 209385 | Oct. 16, 1997 |
| 33089-1132 | 209262 | Sep. 16, 1997 |
| 33092-1202 | 209420 | Oct. 28, 1997 |
| 33100-1159 | 209377 | Oct. 16, 1997 |
| 33223-1136 | 209264 | Sep. 16, 1997 |
| 34392-1170 | 209526 | Dec. 10, 1997 |
| 34431-1177 | 209399 | Oct. 17, 1997 |
| 34433-1308 | 209719 | Mar. 31, 1998 |
| 34434-1139 | 209252 | Sep. 16, 1997 |
| 35600-1162 | 209370 | Oct. 16, 1997 |
| 35673-1201 | 209418 | Oct. 28, 1997 |
| 35880-1160 | 209379 | Oct. 16, 1997 |
| 35918-1174 | 209402 | Oct. 17, 1997 |
| 36350-1158 | 209378 | Oct. 16, 1997 |
| 36638-1056 | 209456 | Nov. 12, 1997 |
| 38268-1188 | 209421 | Oct. 28, 1997 |
| 40370-1217 | 209485 | Nov. 21, 1997 |
| 40628-1216 | 209432 | Nov. 7, 1997 |
| 43316-1237 | 209487 | Nov. 21, 1997 |
| 44196-1353 | 209847 | May 6, 1998 |
| 45409-2511 | 203579 | Jan. 12, 1999 |
| 45419-1252 | 209616 | Feb. 5, 1998 |
| 46777-1253 | 209619 | Feb. 5, 1998 |
| 48336-1309 | 209669 | Mar. 11, 1998 |
| 48606-1479 | 203040 | Jul. 1, 1998 |
| 49435-1219 | 209480 | Nov. 21, 1997 |
| 49631-1328 | 209806 | Apr. 28, 1998 |
| 50919-1361 | 209848 | May 6, 1998 |
| 50920-1325 | 209700 | Mar. 26, 1998 |
| 50921-1458 | 209859 | May 12, 1998 |
| 52758-1399 | 209773 | Apr. 14, 1998 |
| 53517-1366-1 | 209802 | Apr. 23, 1998 |
| 53915-1258 | 209593 | Jan. 21, 1998 |
| 53974-1401 | 209774 | Apr. 14, 1998 |
| 53987-1438 | 209858 | May 12, 1998 |
| 56047-1456 | 209948 | Jun. 9, 1998 |
| 56050-1455 | 203011 | Jun. 23, 1998 |
| 56110-1437 | 203113 | Aug. 11, 1998 |
| 56405-1357 | 209849 | May 6, 1998 |
| 56433-1406 | 209857 | May 12, 1998 |
| 56439-1376 | 209864 | May 14, 1998 |
| 56529-1647 | 203293 | Sep. 29, 1998 |
| 56865-1491 | 203022 | Jun. 23, 1998 |
| 56965-1356 | 209842 | May 6, 1998 |
| 57033-1403-1 | 209905 | May 27, 1998 |
| 57037-1444 | 209903 | May 27, 1998 |
| 57039-1402 | 209777 | Apr. 14, 1998 |
| 57689-1385 | 209869 | May 14, 1998 |
| 57690-1374 | 209950 | Jun. 9, 1998 |
| 57694-1341 | 203017 | Jun. 23, 1998 |

TABLE 7-continued

| Material | ATCC Dep. No. | Deposit Date |
|---|---|---|
| 57695-1340 | 203006 | Jun. 23, 1998 |
| 57699-1412 | 203020 | Jun. 23, 1998 |
| 57700-1408 | 203583 | Jan. 12, 1999 |
| 57708-1411 | 203021 | Jun. 23, 1998 |
| 57838-1337 | 203014 | Jun. 23, 1998 |
| 58847-1383 | 209879 | May 20, 1998 |
| 58852-1637 | 203271 | Sep. 22, 1998 |
| 58853-1423 | 203016 | Jun. 23, 1998 |
| 59212-1627 | 203245 | Sep. 9, 1998 |
| 59220-1514 | 209962 | Jun. 9, 1998 |
| 59493-1420 | 203050 | Jul. 1, 1998 |
| 59497-1496 | 209941 | Jun. 4, 1998 |
| 59586-1520 | 203288 | Sep. 29, 1998 |
| 59588-1571 | 203106 | Aug. 11, 1998 |
| 59620-1463 | 209989 | Jun. 16, 1998 |
| 59622-1334 | 209984 | Jun. 16, 1998 |
| 59777-1480 | 203111 | Aug. 11, 1998 |
| 59848-1512 | 203088 | Aug. 4, 1998 |
| 59849-1504 | 209986 | Jun. 16, 1998 |
| 60621-1516 | 203091 | Aug. 4, 1998 |
| 60622-1525 | 203090 | Aug. 4, 1998 |
| 60764-1533 | 203452 | Nov. 10, 1998 |
| 60783-1611 | 203130 | Aug. 18, 1998 |
| 61755-1554 | 203112 | Aug. 11, 1998 |
| 62306-1570 | 203254 | Sep. 9, 1998 |
| 62312-2558 | 203836 | Mar. 9, 1999 |
| 62814-1521 | 203093 | Aug. 4, 1998 |
| 62872-1509 | 203100 | Aug. 4, 1998 |
| 64883-1526 | 203253 | Sep. 9, 1998 |
| 64886-1601 | 203241 | Sep. 9, 1998 |
| 64889-1541 | 203250 | Sep. 9, 1998 |
| 64896-1539 | 203238 | Sep. 9, 1998 |
| 64897-1628 | 203216 | Sep. 15, 1998 |
| 64903-1553 | 203223 | Sep. 15, 1998 |
| 64908-1163-1 | 203243 | Sep. 9, 1998 |
| 64950-1590 | 203224 | Sep. 15, 1998 |
| 65402-1540 | 203252 | Sep. 9, 1998 |
| 65404-1551 | 203244 | Sep. 9, 1998 |
| 65405-1547 | 203476 | Nov. 17, 1998 |
| 65410-1569 | 203231 | Sep. 15, 1998 |
| 65412-1523 | 203094 | Aug. 4, 1998 |
| 66307-2661 | 431-PTA | Jul. 27, 1999 |
| 66526-1616 | 203246 | Sep. 9, 1998 |
| 66659-1593 | 203269 | Sep. 22, 1998 |
| 66660-1585 | 203279 | Sep. 22, 1998 |
| 66667-1596 | 203267 | Sep. 22, 1998 |
| 66672-1586 | 203265 | Sep. 22, 1998 |
| 66675-1587 | 203282 | Sep. 22, 1998 |
| 67300-1605 | 203163 | Aug. 25, 1998 |
| 68818-2536 | 203657 | Feb. 9, 1999 |
| 68862-2546 | 203652 | Feb. 9, 1999 |
| 68872-1620 | 203160 | Aug. 25, 1998 |
| 71290-1630 | 203275 | Sep. 22, 1998 |
| 73736-1657 | 203466 | Nov. 17, 1998 |
| 73739-1645 | 203270 | Sep. 22, 1998 |
| 73742-1662 | 203316 | Oct. 6, 1998 |
| 76385-1692 | 203664 | Feb. 9, 1999 |
| 76393-1664 | 203323 | Oct. 6, 1998 |
| 76399-1700 | 203472 | Nov. 17, 1998 |
| 76400-2528 | 203573 | Jan. 12, 1999 |
| 76510-2504 | 203477 | Nov. 17, 1998 |
| 76529-1666 | 203315 | Oct. 6, 1998 |
| 76532-1702 | 203473 | Nov. 17, 1998 |
| 76541-1675 | 203409 | Oct. 27, 1998 |
| 77503-1686 | 203362 | Oct. 20, 1998 |
| 77624-2515 | 203553 | Dec. 22, 1998 |
| 79230-2525 | 203549 | Dec. 22, 1998 |
| 79862-2522 | 203550 | Dec. 22, 1998 |
| 80145-2594 | 204-PTA | Jun. 8, 1999 |
| 80899-2501 | 203539 | Dec. 15, 1998 |
| 81754-2532 | 203542 | Dec. 15, 1998 |
| 81757-2512 | 203543 | Dec. 15, 1998 |
| 81761-2583 | 203862 | Mar. 23, 1999 |
| 82358-2738 | 510-PTA | Aug. 10, 1999 |
| 82364-2538 | 203603 | Jan. 20, 1999 |
| 82403-2959 | 2317-PTA | Aug. 1, 2000 |
| 83500-2506 | 203391 | Oct. 29, 1998 |

TABLE 7-continued

| Material | ATCC Dep. No. | Deposit Date |
| --- | --- | --- |
| 83560-2569 | 203816 | Mar. 2, 1999 |
| 84210-2576 | 203818 | Mar. 2, 1999 |
| 84920-2614 | 203966 | Apr. 27, 1999 |
| 86576-2595 | 203868 | Mar. 23, 1999 |
| 92218-2554 | 203834 | Mar. 9, 1999 |
| 92233-2599 | 134-PTA | May 25, 1999 |
| 92256-2596 | 203891 | Mar. 30, 1999 |
| 92265-2669 | 256-PTA | Jun. 22, 1999 |
| 92274-2617 | 203971 | Apr. 27, 1999 |
| 92929-2534-1 | 203586 | Jan. 12, 1999 |
| 93011-2637 | 20-PTA | May 4, 1999 |
| 94854-2586 | 203864 | Mar. 23, 1999 |
| 96787-2534-1 | 203589 | Jan. 12, 1999 |
| 96867-2620 | 203972 | Apr. 27, 1999 |
| 96872-2674 | 550-PTA | Aug. 17, 1999 |
| 96878-2626 | 23-PTA | May 4, 1999 |
| 96889-2641 | 119-PTA | May 25, 1999 |
| 100312-2645 | 44-PTA | May 11, 1999 |
| 105782-2693 | 387-PTA | Jul. 20, 1999 |
| 105849-2704 | 473-PTA | Aug. 3, 1999 |
| 108725-2766 | 863-PTA | Oct. 19, 1999 |
| 108769-2765 | 861-PTA | Oct. 19, 1999 |
| 119498-2965 | 2298-PTA | Jul. 25, 2000 |
| 119535-2756 | 613-PTA | Aug. 31, 1999 |
| 125185-2806 | 1031-PTA | Dec. 7, 1999 |
| 131639-2874 | 1784-PTA | Apr. 25, 2000 |
| 139623-2893 | 1670-PTA | Apr. 11, 2000 |
| 143076-2787 | 1028-PTA | Dec. 7, 1999 |
| 143276-2975 | 2387-PTA | Aug. 8, 2000 |
| 164625 2890 | 1535-PTA | Mar. 21, 2000 |
| 167678-2963 | 2302-PTA | Jul. 25, 2000 |
| 170021-2923 | 1906-PTA | May 23, 2000 |
| 170212-3000 | 2583-PTA | Oct. 10, 2000 |
| 177313-2982 | 2251-PTA | Jul. 19, 2000 |

These deposits were made under the provisions of the Budapest Treaty on the International Recognition of the Deposit of Microorganisms for the Purpose of Patent Procedure and the Regulations there under (Budapest Treaty). This assures maintenance of a viable culture of the deposit for 30 years from the date of deposit and for at least five (5) years after the most recent request for the furnishing of a sample of the deposit received by the depository. The deposits will be made available by ATCC under the terms of the Budapest Treaty, and subject to an agreement between Genentech, Inc. and ATCC, which assures that all restrictions imposed by the depositor on the availability to the public of the deposited material will be irrevocably removed upon the granting of the pertinent U.S. patent, assures permanent and unrestricted availability of the progeny of the culture of the deposit to the public upon issuance of the pertinent U.S. patent or upon laying open to the public of any U.S. or foreign patent application, whichever comes first, and assures availability of the progeny to one determined by the U.S. Commissioner of Patents and Trademarks to be entitled thereto according to 35 U.S.C. § 122 and the Commissioner's rules pursuant thereto (including 37 C.F.R. § 1.14 with particular reference to 886 OG 638).

The assignee of the present application has agreed that if a culture of the materials on deposit should die or be lost or destroyed when cultivated under suitable conditions, the materials will be promptly replaced on notification with another of the same. Availability of the deposited material is not to be construed as a license to practice the invention in contravention of the rights granted under the authority of any government in accordance with its patent laws.

6.5 Example 5

Isolation of cDNA Clones Encoding Human PRO1873, PRO7223, PRO7248, PRO730, PRO532, PRO7261, PRO734, PRO771, PRO2010, PRO5723, PRO3444, PRO9940, PRO3562, PRO10008, PRO5730, PRO6008, PRO4527, PRO4538 and PRO4553

DNA molecules encoding the PRO1873, PRO7223, PRO7248, PRO730, PRO532, PRO7261, PRO734, PRO771, PRO2010, PRO5723, PRO3444, PRO9940, PRO3562, PRO10008, PRO5730, PRO6008, PRO4527, PRO4538 and PRO4553 polypeptides shown in the accompanying figures were obtained through GenBank.

6.6. Example 6

Use of PRO as a Hybridization Probe

The following method describes use of a nucleotide sequence encoding PRO as a hybridization probe.

DNA comprising the coding sequence of full-length or mature PRO (as shown in accompanying figures) or a fragment thereof is employed as a probe to screen for homologous DNAs (such as those encoding naturally-occurring variants of PRO) in human tissue cDNA libraries or human tissue genomic libraries.

Hybridization and washing of filters containing either library DNAs is performed under the following high-stringency conditions. Hybridization of radiolabeled probe derived from the gene encoding PRO polypeptide to the filters is performed in a solution of 50% formamide, 5×SSC, 0. 1% SDS, 0.1% sodium pyrophosphate, 50 mM sodium phosphate, pH 6.8, 2× Denhardt's solution, and 10% dextran sulfate at 42° C. for 20 hours. Washing of the filters is performed in an aqueous solution of 0. 1×SSC and 0.1% SDS at 42° C.

DNAs having a desired sequence identity with the DNA encoding full-length native sequence can then be identified using standard techniques known in the art.

6.7. Example 7

Expression of PRO in *E. coli*

This example illustrates preparation of an unglycosylated form of PRO by recombinant expression in *E. coli*.

The DNA sequence encoding PRO is initially amplified using selected PCR primers. The primers should contain restriction enzyme sites which correspond to the restriction enzyme sites on the selected expression vector. A variety of expression vectors may be employed. An example of a suitable vector is pBR322 (derived from *E. coli*; see, Bolivar et al., *Gene*, 2:95 (1977)) which contains genes for ampicillin and tetracycline resistance. The vector is digested with restriction enzyme and dephosphorylated. The PCR amplified sequences are then ligated into the vector. The vector will preferably include sequences which encode for an antibiotic resistance gene, a trp promoter, a poly-His leader (including the first six STII codons, poly-His sequence, and enterokinase cleavage site), the PRO coding region, lambda transcriptional terminator, and an argU gene.

The ligation mixture is then used to transform a selected *E. coli* strain using the methods described in Sambrook et al., supra. Transformants are identified by their ability to grow on LB plates and antibiotic resistant colonies are then selected. Plasmid DNA can be isolated and confirmed by restriction analysis and DNA sequencing.

Selected clones can be grown overnight in liquid culture medium such as LB broth supplemented with antibiotics. The overnight culture may subsequently be used to inoculate a larger scale culture. The cells are then grown to a desired optical density, during which the expression promoter is turned on.

After culturing the cells for several more hours, the cells can be harvested by centrifugation. The cell pellet obtained by the centrifugation can be solubilized using various agents known in the art, and the solubilized PRO protein can then be purified using a metal chelating column under conditions that allow tight binding of the protein.

PRO may be expressed in *E. coli* in a poly-His tagged form, using the following procedure. The DNA encoding PRO is initially amplified using selected PCR primers. The primers will contain restriction enzyme sites which correspond to the restriction enzyme sites on the selected expression vector, and other useful sequences providing for efficient and reliable translation initiation, rapid purification on a metal chelation column, and proteolytic removal with enterokinase. The PCR-amplified, poly-His tagged sequences are then ligated into an expression vector, which is used to transform an *E. coli* host based on strain 52 (W3110 fuhA(tonA) lon galE rpoHts(htpRts) clpP(lacIq). Transformants are first grown in LB containing 50 mg/ml carbenicillin at 30° C. with shaking until an $OD_{600}$ of 3–5 is reached. Cultures are then diluted 50–100 fold into CRAP media (prepared by mixing 3.57 g $(NH_4)_2SO_4$, 0.71 g sodium citrate $2H_2O$, 1.07 g KCl, 5.36 g Difco yeast extract, 5.36 g Sheffield hycase SF in 500 ml water, as well as 110 mM MPOS, pH 7.3,0.55% (w/v) glucose and 7 MM $MgSO_4$) and grown for approximately 20–30 hours at 30° C. with shaking. Samples are removed to verify expression by SDS-PAGE analysis, and the bulk culture is centrifuged to pellet the cells. Cell pellets are frozen until purification and refolding.

*E. coli* paste from 0.5 to 1 L fermentations (6–10 g pellets) is resuspended in 10 volumes (w/v) in 7 M guamidine, 20 mM Tris, pH 8 buffer. Solid sodium sulfite and sodium tetrathionate is added to make final concentrations of 0.1M and 0.02 M, respectively, and the solution is stirred ovemight at 4° C. This step results in a denatured protein with all cysteine residues blocked by sulfitolization. The solution is centrifuged at 40,000 rpm in a Beckman Ultracentifuge for 30 min. The supernatant is diluted with 3–5 volumes of metal chelate column buffer (6 M guamidine, 20 mM Tris, pH 7.4) and filtered through 0.22 micron filters to clarify. The clarified extract is loaded onto a 5 ml Qiagen $Ni^{2+}$-NTA metal chelate column equilibrated in the metal chelate column buffer. The column is washed with additional buffer containing 50 mM imidazole (Calbiochem, Utrol grade), pH 7.4. The protein is eluted with buffer containing 250 mM imidazole. Fractions containing the desired protein are pooled and stored at 4° C. Protein concentration is estimated by its absorbance at 280 nm using the calculated extinction coefficient based on its amino acid sequence.

The proteins are refolded by diluting the sample slowly into freshly prepared refolding buffer consisting of: 20 mM Tris, pH 8.6, 0.3 M NaCl, 2.5 M urea, 5 mM cysteine, 20 mM glycine and 1 mM EDTA. Refolding volumes are chosen so that the final protein concentration is between 50 to 100 micrograms/ml. The refolding solution is stirred gently at 4° C. for 12–36 hours. The refolding reaction is quenched by the addition of TFA to a final concentration of 0.4% (pH of approximately 3). Before further purification of the protein, the solution is filtered through a 0.22 micron filter and acetonitrile is added to 2–10% final concentration. The refolded protein is chromatographed on a Poros R1/H reversed phase column using a mobile buffer of 0.1% TFA with elution with a gradient of acetonitrile from 10 to 80%. Aliquots of fractions with $A_{280}$ absorbance are analyzed on SDS polyacrylamide gels and fractions containing homogeneous refolded protein are pooled. Generally, the properly refolded species of most proteins are eluted at the lowest concentrations of acetonitrile since those species are the most compact with their hydrophobic interiors shielded from interaction with the reversed phase resin. Aggregated species are usually eluted at higher acetonitrile concentrations. In addition to resolving misfolded forms of proteins from the desired form, the reversed phase step also removes endotoxin from the samples.

Fractions containing the desired folded PRO polypeptide are pooled and the acetonitrile removed using a gentle stream of nitrogen directed at the solution. Proteins are formulated into 20 mM Hepes, pH 6.8 with 0.14 M sodium chloride and 4% mannitol by dialysis or by gel filtration using G25 Superfine (Pharmacia) resins equilibrated in the formulation buffer and sterile filtered.

Many of the PRO polypeptides disclosed herein were successfully expressed as descibed above.

6.8. Example 8

Expression of PRO in Mammalian Cells

This example illustrates preparation of a potentially glycosylated form of PRO by recombinant expression in mammalian cells.

The vector, pRK5 (see EP 307,247, published Mar. 15, 1989), is employed as the expression vector. Optionally, the PRO DNA is ligated into pRK5 with selected restriction enzymes to allow insertion of the PRO DNA using ligation methods such as described in Sambrook et al, supra. The resulting vector is called pRK5-PRO.

In one embodiment, the selected host cells may be 293 cells. Human 293 cells (ATCC CCL 1573) are grown to confluence in tissue culture plates in medium such as DMEM supplemented with fetal calf serum and optionally, nutrient components and/or antibiotics. About 10 μg pRK5-PRO DNA is mixed with about 1 μg DNA encoding the VA RNA gene [Thimmappaya et al., *Cell*, 31:543 (1982)] and dissolved in 500 μl of 1 mM Tris-HCl 0.1 mM EDTA, 0.227 M $CaCl_2$. To this mixture is added, dropwise, 500 μl of 50 mM HEPES (pH 7.35), 280 mM NaCl, 1.5 mM $NaPO_4$, and a precipitate is allowed to form for 10 minutes at 25° C. The precipitate is suspended and added to the 293 cells and allowed to settle for about four hours at 37° C. The culture medium is aspirated off and 2 ml of 20% glycerol in PBS is added for 30 seconds. The 293 cells are then washed with serum free medium, fresh medium is added and the cells are incubated for about 5 days.

Approximately 24 hours after the transfections, the culture medium is removed and replaced with culture medium (alone) or culture medium containing 200 μCi/ml $^{35}$S-cysteine and 200 μCi/ml $^{35}$S-methionine. After a 12 hour incubation, the conditioned medium is collected, concentrated on a spin filter, and loaded onto a 15% SDS gel. The processed gel may be dried and exposed to film for a selected period of time to reveal the presence of the PRO polypeptide. The cultures containing transfected cells may undergo further incubation (in serum free medium) and the medium is tested in selected bioassays.

In an alternative technique, PRO may be introduced into 293 cells transiently using the dextran sulfate method described by Somparyrac et al., *Proc. Natl. Acad. Sci.*, 12:7575 (1981). 293 cells are grown to maximal density in a spinner flask and 700 µg pRK5-PRO DNA is added. The cells are first concentrated from the spinner flask by centrifugation and washed with PBS. The DNA-dextran precipitate is incubated on the cell pellet for four hours. The cells are treated with 20% glycerol for 90 seconds, washed with tissue culture medium, and re-introduced into the spinner flask containing tissue culture medium, 5 µg/ml bovine insulin and 0.1 µg/ml bovine transferrin. After about four days, the conditioned media is centrifuged and filtered to remove cells and debris. The sample containing expressed PRO can then be concentrated and purified by any selected method, such as dialysis and/or column chromatography.

In another embodiment, PRO can be expressed in CHO cells. The pRK5-PRO can be transfected into CHO cells using known reagents such as $CaPO_4$ or DEAE-dextran. As described above, the cell cultures can be incubated, and the medium replaced with culture medium (alone) or medium containing a radiolabel such as $^{35}S$-methionine. After determining the presence of a PRO polypeptide, the culture medium may be replaced with serum free medium. Preferably, the cultures are incubated for about 6 days, and then the conditioned medium is harvested.

The medium containing the expressed PRO polypeptide can then be concentrated and purified by any selected method.

Epitope-tagged PRO may also be expressed in host CHO cells. The PRO may be subcloned out of the pRK5 vector. The subclone insert can undergo PCR to fuse in frame with a selected epitope tag such as a poly-His tag into a Baculovirus expression vector. The poly-His tagged PRO insert can then be subcloned into a SV40 driven vector containing a selection marker such as DHFR for selection of stable clones. Finally, the CHO cells can be transfected (as described above) with the SV40 driven vector. Labeling may be performed, as described above, to verify expression. The culture medium containing the expressed poly-His tagged PRO can then be concentrated and purified by any selected method, such as by $Ni^{2+}$-chelate affinity chromatography.

PRO may also be expressed in CHO and/or COS cells by a transient expression procedure or in CHO cells by another stable expression procedure.

Stable expression in CHO cells is performed using the following procedure. The proteins are expressed as an IgG construct (immunoadhesin), in which the coding sequences for the soluble forms (e.g., extracellular domains) of the respective proteins are fused to an IgG1 constant region sequence containing the hinge, CH2 and CH2 domains and/or as a poly-His tagged form.

Following PCR amplification, the respective DNAs are subcloned in a CHO expression vector using standard techniques as described in Ausubel et al., *Current Protocols of Molecular Biology*, Unit 3.16, John Wiley and Sons (1997). CHO expression vectors are constructed to have compatible restriction sites 5' and 3' of the DNA of interest to allow the convenient shuttling of cDNA's. The vector used in expression in CHO cells is as described in Lucas et al., *Nucl. Acids Res.*, 24:9 (1774–1779) (1996), and uses the SV40 early promoter/enhancer to drive expression of the cDNA of interest and dihydrofolate reductase (DHFR). DHFR expression permits selection for stable maintenance of the plasmid following transfection.

Twelve micrograms of the desired plasmid DNA is introduced into approximately 10 million CHO cells using commercially available transfection reagents Superfect® (Qiagen), Dosper® or Fugene® (Boehringer Mannheim). The cells are grown as described in Lucas et al., supra. Approximately $3 \times 10^7$ cells are frozen in an ampule for further growth and production as described below.

The ampules containing the plasmid DNA are thawed by placement into a water bath and mixed by vortexing. The contents are pipetted into a centrifuge tube containing 10 ml of media and centrifuged at 1000 rpm for 5 minutes. The supernatant is aspirated and the cells are resuspended in 10 ml of selective media (0.2 µm filtered PS20 with 5% 0.2 µm diafiltered fetal bovine serum). The cells are then aliquoted into a 100 ml spinner containing 90 ml of selective media. After 1–2 days, the cells are transferred into a 250 ml spinner filled with 150 ml selective growth medium and incubated at 37° C. After another 2–3 days, 250 ml, 500 ml and 2000 ml spinners are seeded with $3 \times 10^5$ cells/ml. The cell media is exchanged with fresh media by centrifugation and resuspension in production medium. Although any suitable CHO media may be employed, a production medium described in U.S. Pat. No. 5,122,469, issued Jun. 16, 1992 may actually be used. A 3L production spinner is seeded at $1.2 \times 10^6$ cells/ml. On day 0, the cell number and pH is determined, On day 1, the spinner is sampled and sparging with filtered air is commenced. On day 2, the spinner is sampled, the temperature shifted to 33° C., and 30 ml of 500 g/L glucose and 0.6 ml of 10% antifoam (e.g., 35% polydimethylsiloxane emulsion, Dow Corning 365 Medical Grade Emulsion) taken. Throughout the production, the pH is adjusted as necessary to keep it at around 7.2. After 10 days, or until the viability drops below 70%, the cell culture is harvested by centrifugation and filtering through a 0.22 µm filter. The filtrate is either stored at 4° C. or immediately loaded onto columns for purification.

For the poly-His tagged constructs, the proteins are purified using a $Ni^{2+}$-NTA column (Qiagen). Before purification, imidazole is added to the conditioned media to a concentration of 5 mM. The conditioned media is pumped onto a 6 ml $Ni^{2+}$-NTA column equilibrated in 20 mM Hepes, pH 7.4, buffer containing 0.3 M NaCl and 5 mM imidazole at a flow rate of 4–5 ml/min. at 4° C. After loading, the column is washed with additional equilibration buffer and the protein eluted with equilibration buffer containing 0.25 M imidazole. The highly purified protein is subsequently desalted into a storage buffer containing 10 mM Hepes, 0.14 M NaCl and 4% mannitol, pH 6.8, with a 25 ml G25 Superfine (Pharmacia) column and stored at −80° C.

Immunoadhesin (Fc-containing) constructs are purified from the conditioned media as follows. The conditioned medium is pumped onto a 5 ml Protein A column (Pharmacia) which has been equilibrated in 20 mM Na phosphate buffer, pH 6.8. After loading, the column is washed extensively with equilibration buffer before elution with 100 mM citric acid, pH 3.5. The eluted protein is immediately neutralized by collecting 1 ml fractions into tubes containing 275 µl of 1 M Tris buffer, pH 9. The highly purified protein is subsequently desalted into storage buffer as described above for the poly-His tagged proteins. The homogeneity is assessed by SDS polyacrylamide gels and by N-terminal amino acid sequencing by Edman degradation.

Many of the PRO polypeptides disclosed herein were successfully expressed as descibed above.

6.9. Example 9

Expression of PRO in Yeast

The following method describes recombinant expression of PRO in yeast.

First, yeast expression vectors are constructed for intracellular production or secretion of PRO from the ADH2/GAPDH promoter. DNA encoding PRO and the promoter is inserted into suitable restriction enzyme sites in the selected plasmid to direct intracellular expression of PRO. For secretion, DNA encoding PRO can be cloned into the selected plasmid, together with DNA encoding the ADH2/GAPDH promoter, a native PRO signal peptide or other mammalian signal peptide, or, for example, a yeast alpha-factor or invertase secretory signal/leader sequence, and linker sequences (if needed) for expression of PRO.

Yeast cells, such as yeast strain AB110, can then be transformed with the expression plasmids described above and cultured in selected fermentation media. The transformed yeast supernatants can be analyzed by precipitation with 10% trichloroacetic acid and separation by SDS-PAGE, followed by staining of the gels with Coomassie Blue stain.

Recombinant PRO can subsequently be isolated and purified by removing the yeast cells from the fermentation medium by centrifugation and then concentrating the medium using selected cartridge filters. The concentrate containing PRO may further be purified using selected column chromatography resins.

Many of the PRO polypeptides disclosed herein were successfully expressed as described above.

6.10. Example 10

Expression of PRO in Baculovirus-Infected Insect Cells

The following method describes recombinant expression in Baculovirus-infected insect cells.

The sequence coding for PRO is fused upstream of an epitope tag contained within a baculovirus expression vector. Such epitope tags include poly-His tags and immunoglobulin tags (like Fc regions of IgG). A variety of plasmids may be employed, including plasmids derived from commercially available plasmids such as pVL1393 (Novagen). Briefly, the sequence encoding PRO or the desired portion of the coding sequence of PRO (such as the sequence encoding the extracellular domain of a transmembrane protein or the sequence encoding the mature protein if the protein is extracellular) is amplified by PCR with primers complementary to the 5' and 3' regions. The 5' primer may incorporate flanking (selected) restriction enzyme sites. The product is then digested with those selected restriction enzymes and subcloned into the expression vector.

Recombinant baculovirus is generated by co-transfecting the above plasmid and BaculoGold™ virus DNA (Pharmingen) into *Spodoptera frugiperda* ("Sf9") cells (ATCC CRL 1711) using lipofectin (commercially available from GIBCO-BRL). After 4–5 days of incubation at 28° C., the released viruses are harvested and used for further amplifications. Viral infection and protein expression are performed as described by O'Reilley et al., *Baculovirus expression vectors: A Laboratory Manual*, Oxford: Oxford University Press (1994).

Expressed poly-His tagged PRO can then be purified, for example, by $Ni^{2+}$-chelate affinity chromatography as follows. Extracts are prepared from recombinant virus-infected Sf9 cells as described by Rupert et al., *Nature*, 362:175–179 (1993). Briefly, Sf9 cells are washed, resuspended in sonication buffer (25 ml Hepes, pH 7.9; 12.5 mM $MgCl_2$; 0.1 mM EDTA; 10% glycerol; 0.1% NP-40; 0.4 M KCl), and sonicated twice for 20 seconds on ice. The sonicates are cleared by centrifugation, and the supernatant is diluted 50-fold in loading buffer (50 mM phosphate, 300 mM NaCl, 10% glycerol, pH 7.8) and filtered through a 0.45 µm filter. A $Ni^{2+}$-NTA agarose column (commercially available from Qiagen) is prepared with a bed volume of 5 ml, washed with 25 ml of water and equilibrated with 25 ml of loading buffer. The filtered cell extract is loaded onto the column at 0.5 ml per minute. The column is washed to baseline $A_{280}$ with loading buffer, at which point fraction collection is started. Next, the column is washed with a secondary wash buffer (50 mM phosphate; 300 mM NaCl, 10% glycerol, pH 6.0), which elutes nonspecifically bound protein. After reaching $A_{280}$ baseline again, the column is developed with a 0 to 500 mM imidazole gradient in the secondary wash buffer. One ml fractions are collected and analyzed by SDS-PAGE and silver staining or Western blot with $Ni^{2+}$-NTA-conjugated to alkaline phosphatase (Qiagen). Fractions containing the eluted $His_{10}$-tagged PRO are pooled and dialyzed against loading buffer.

Alternatively, purification of the IgG tagged (or Fc tagged) PRO can be performed using known chromatography techniques, including for instance, Protein A or protein G column chromatography.

Following PCR amplification, the respective coding sequences are subcloned into a baculovirus expression vector (pb.PH.IgG for IgG fusions and pb.PH.His.c for poly-His tagged proteins), and the vector and Baculogold® baculovirus DNA (Pharmingen) are co-transfected into 105 *Spodoptera frugiperda* ("Sf9") cells (ATCC CRL 1711), using Lipofectin (Gibco BRL). pb.PH.IgG and pb.PH.His are modifications of the commercially available baculovirus expression vector pVL1393 (Pharmingen), with modified polylinker regions to include the His or Fc tag sequences. The cells are grown in Hink's TNM-FH medium supplemented with 10% FBS (Hyclone). Cells are incubated for 5 days at 28° C. The supernatant is harvested and subsequently used for the first viral amplification by infecting Sf9 cells in Hink's TNM-FH medium supplemented with 10% FBS at an approximate multiplicity of infection (MOI) of 10. Cells are incubated for 3 days at 28° C. The supernatant is harvested and the expression of the constructs in the baculovirus expression vector is determined by batch binding of 1 ml of supernatant to 25 ml of $Ni^{2+}$-NTA beads (QIAGEN) for histidine tagged proteins or Protein-A Sepharose CL-4B beads (Pharmacia) for IgG tagged proteins followed by SDS-PAGE analysis comparing to a known concentration of protein standard by Coomassie blue staining.

The first viral amplification supernatant is used to infect a spinner culture (500 ml) of Sf9 cells grown in ESF-921 medium (Expression Systems LLC) at an approximate MOI of 0.1. Cells are incubated for 3 days at 28° C. The supernatant is harvested and filtered. Batch binding and SDS-PAGE analysis is repeated, as necessary, until expression of the spinner culture is confirmed.

The conditioned medium from the transfected cells (0.5 to 3 L) is harvested by centrifugation to remove the cells and filtered through 0.22 micron filters. For the poly-His tagged constructs, the protein construct is purified using a $Ni^{2+}$-NTA column (Qiagen). Before purification, imidazole is added to the conditioned media to a concentration of 5 mM. The conditioned media is pumped onto a 6 ml $Ni^{2+}$-NTA column equilibrated in 20 mM Hepes, pH 7.4, buffer containing 0.3 M NaCl and 5 mM imidazole at a flow rate of 4–5 ml/min. at 4° C. After loading, the column is washed with additional equilibration buffer and the protein eluted with equilibration buffer containing 0.25 M imidazole. The highly purified protein is subsequently desalted into a storage buffer containing 10 mM Hepes, 0.14 M NaCl and 4% mannitol, pH 6.8, with a 25 ml G25 Superfine (Pharmacia) column and stored at −80° C.

Immunoadhesin (Fc containing) constructs of proteins are purified from the conditioned media as follows. The conditioned media is pumped onto a 5 ml Protein A column (Pharmacia) which has been equilibrated in 20 mM Na phosphate buffer, pH 6.8. After loading, the column is washed extensively with equilibration buffer before elution with 100 mM citric acid, pH 3.5. The eluted protein is immediately neutralized by collecting 1 ml fractions into tubes containing 275 ml of 1 M Tris buffer, pH 9. The highly purified protein is subsequently desalted into storage buffer as described above for the poly-His tagged proteins. The homogeneity of the proteins is verified by SDS polyacrylamide gel (PEG) electrophoresis and N-terminal amino acid sequencing by Edman degradation.

Alternatively, a modified baculovirus procedure may be used incorporating high-5 cells. In this procedure, the DNA encoding the desired sequence is amplified with suitable systems, such as Pfu (Stratagene), or fused upstream (5'-of) of an epitope tag contained with a baculovirus expression vector. Such epitope tags include poly-His tags and immunoglobulin tags (like Fc regions of IgG). A variety of plasmids may be employed, including plasmids derived from commercially available plasmids such as pIE1-1 (Novagen). The pIE1-1 and pIE1-2 vectors are designed for constitutive expression of recombinant proteins from the baculovirus ie1 promoter in stably-transformed insect cells (1). The plasmids differ only in the orientation of the multiple cloning sites and contain all promoter sequences known to be important for ie1-mediated gene expression in uninfected insect cells as well as the hr5 enhancer element. pIE1-1 and pIE1-2 include the translation initiation site and can be used to produce fusion proteins. Briefly, the desired sequence or the desired portion of the sequence (such as the sequence encoding the extracellular domain of a transmembrane protein) is amplified by PCR with primers complementary to the 5' and 3' regions. The 5' primer may incorporate flanking (selected) restriction enzyme sites. The product is then digested with those selectedrestrictionenzymes and subcloned into the expression vector. For example, derivatives of pIE1-1 can include the Fc region of human IgG (pb.PH.IgG) or an 8 histidine (pb.PH.His) tag downstream (3'-of) the desired sequence. Preferably, the vector construct is sequenced for confirmation.

High-5 cells are grown to a confluency of 50% under the conditions of, 27° C., no $CO_2$, NO pen/strep. For each 150 mm plate, 30 µg of pIE based vector containing the sequence is mixed with 1 ml Ex-Cell medium (Media: Ex-Cell 401+ 1/100 L-Glu JRH Biosciences #14401-78P (note: this media is light sensitive)), and in a separate tube, 100 µl of CellFectin (CellFECTIN (GibcoBRL #10362-010) (vortexed to mix)) is mixed with 1 ml of Ex-Cell medium. The two solutions are combined and allowed to incubate at room temperature for 15 minutes. 8 ml of Ex-Cell media is added to the 2 ml of DNA/CellFECTIN mix and this is layered on high-5 cells that have been washed once with Ex-Cell media. The plate is then incubated in darkness for 1 hour at room temperature. The DNA/CellFECTIN mix is then aspirated, and the cells are washed once with Ex-Cell to remove excess CellFECTIN, 30 ml of fresh Ex-Cell media is added and the cells are incubated for 3 days at 28° C. The supernatant is harvested and the expression of the sequence in the baculovirus expression vector is determined by batch binding of 1 ml of supernatent to 25 ml of $Ni^{2+}$-NTA beads (QIAGEN) for histidine tagged proteins or Protein-A Sepharose CL-4B beads (Pharmacia) for IgG tagged proteins followed by SDS-PAGE analysis comparing to a known concentration of protein standard by Coomassie blue staining.

The conditioned media from the transfected cells (0.5 to 3 L) is harvested by centrifugation to remove the cells and filtered through 0.22 micron filters. For the poly-His tagged constructs, the protein comprising the sequence is purified using a $Ni^{2+}$-NTA column (Qiagen). Before purification, imidazole is added to the conditioned media to a concentration of 5 mM. The conditioned media is pumped onto a 6 ml $Ni^{2+}$-NTA column equilibrated in 20 mM Hepes, pH 7.4, buffer containing 0.3 M NaCl and 5 mM imidazole at a flow rate of 4–5 ml/min. at 48° C. After loading, the column is washed with additional equilibration buffer and the protein eluted with equilibration buffer containing 0.25 M imidazole. The highly purified protein is then subsequently desalted into a storage buffer containing 10 mM Hepes, 0.14 M NaCl and 4% mannitol, pH 6.8, with a 25 ml G25 Superfine (Pharmacia) column and stored at −80° C.

Immunoadhesin (Fc containing) constructs of proteins are purified from the conditioned media as follows. The conditioned media is pumped onto a 5 ml Protein A column (Pharmacia) which had been equilibrated in 20 mM Na phosphate buffer, pH 6.8. After loading, the column is washed extensively with equilibration buffer before elution with 100 mM citric acid, pH 3.5. The eluted protein is immediately neutralized by collecting 1 ml fractions into tubes containing 275 ml of 1 M Tris buffer, pH 9. The highly purified protein is subsequently desalted into storage buffer as described above for the poly-His tagged proteins. The homogeneity of the sequence is assessed by SDS polyacrylamide gels and by N-terminal amino acid sequencing by Edman degradation and other analytical procedures as desired or necessary.

Many of the PRO polypeptides disclosed herein were successfully expressed as described above.

6.11. Example 11

Preparation of Antibodies that Bind PRO

This example illustrates preparation of monoclonal antibodies which can specifically bind the PRO polypeptide or an epitope on the PRO polypeptide without substantially binding to any other polypeptide or polypeptide epitope.

Techniques for producing the monoclonal antibodies are known in the art and are described, for instance, in Goding, supra. Immunogens that may be employed include purified PRO, fusion proteins containing PRO, and cells expressing recombinant PRO on the cell surface. Selection of the immunogen can be made by the skilled artisan without undue experimentation.

Mice, such as Balb/c, are immunized with the PRO immunogen emulsified in complete Freund's adjuvant and injected subcutaneously or intraperitoneally in an amount from 1–100 micrograms. Alternatively, the immunogen is emulsified in MPL-TDM adjuvant (Ribi Immunochemical Research, Hamilton, Mont.) and injected into the animal's hind foot pads. The immunized mice are then boosted 10 to 12 days later with additional immunogen emulsified in the selected adjuvant. Thereafter, for several weeks, the mice may also be boosted with additional immunization injections. Serum samples may be periodically obtained from the mice by retro-orbital bleeding for testing in ELISA assays to detect anti-PRO antibodies.

After a suitable antibody titer has been detected, the animals "positive" for antibodies can be injected with a final intravenous injection of PRO. Three to four days later, the mice are sacrificed and the spleen cells are harvested. The spleen cells are then fused (using 35% polyethylene glycol) to a selected murine myeloma cell line such as P3X63AgU.1, available from ATCC, No. CRL 1597. The fusions generate hybridoma cells which can then be plated in 96 well tissue culture plates containing HAT (hypoxanthine, aminopterin, and thymidine) medium to inhibit proliferation of non-fused cells, myeloma hybrids, and spleen cell hybrids.

The hybridoma cells will be screened in an ELISA for reactivity against PRO. Determination of "positive" hybridoma cells secreting the desired monoclonal antibodies against PRO is within the skill in the art.

The positive hybridoma cells can be injected intraperitoneally into syngeneic Balb/c mice to produce ascites containing the anti-PRO monoclonal antibodies. Alternatively, the hybridoma cells can be grown in tissue culture flasks or roller bottles. Purification of the monoclonal antibodies produced in the ascites can be accomplished using ammonium sulfate precipitation, followed by gel exclusion chromatography. Alternatively, affinity chromatography based upon binding of antibody to protein A or protein G can be employed.

6.12. Example 12

Purification of PRO Polypeptides Using Specific Antibodies

Native or recombinant PRO polypeptides may be purified by a variety of standard techniques in the art of protein purification. For example, pro-PRO polypeptide, mature PRO polypeptide, or pre-PRO polypeptide is purified by immunoaffinity chromatography using antibodies specific for the PRO polypeptide of interest. In general, an immunoaffinity column is constructed by covalently coupling the anti-PRO polypeptide antibody to an activated chromatographic resin.

Polyclonal immunoglobulins are prepared from immune sera either by precipitation with ammonium sulfate or by purification on immobilized Protein A (Pharmacia LKB Biotechnology, Piscataway, N.J.). Likewise, monoclonal antibodies are prepared from mouse ascites fluid by ammonium sulfate precipitation or chromatography on immobilized Protein A. Partially purified immunoglobulin is covalently attached to a chromatographic resin such as CnBr-activated SEPHAROSE™ (Pharmacia LKB Biotechnology). The antibody is coupled to the resin, the resin is blocked, and the derivative resin is washed according to the manufacturer's instructions.

Such an immunoaffinity column is utilized in the purification of PRO polypeptide by preparing a fraction from cells containing PRO polypeptide in a soluble form. This preparation is derived by solubilization of the whole cell or of a subcellular fraction obtained via differential centrifugation by the addition of detergent or by other methods well known in the art. Alternatively, soluble PRO polypeptide containing a signal sequence may be secreted in useful quantity into the medium in which the cells are grown.

A soluble PRO polypeptide-containing preparation is passed over the immunoaffinity column, and the column is washed under conditions that allow the preferential absorbance of PRO polypeptide (e.g., high ionic strength buffers in the presence of detergent). Then, the column is eluted under conditions that disrupt antibody/PRO polypeptide binding (e.g., a low pH buffer such as approximately pH 2–3, or a high concentration of a chaotrope such as urea or thiocyanate ion), and PRO polypeptide is collected.

6.13. Example 13

Drug Screening

This invention is particularly useful for screening compounds by using PRO polypeptides or binding fragment thereof in any of a variety of drug screening techniques. The PRO polypeptide or fragment employed in such a test may either be free in solution, affixed to a solid support, borne on a cell surface, or located intracellularly. One method of drug screening utilizes eukaryotic or prokaryotic host cells which are stably transformed with recombinant nucleic acids expressing the PRO polypeptide or fragment. Drugs are screened against such transformed cells in competitive binding assays. Such cells, either in viable or fixed form, can be used for standard binding assays. One may measure, for example, the formation of complexes between PRO polypeptide or a fragment and the agent being tested. Alternatively, one can examine the diminution in complex formation between the PRO polypeptide and its target cell or target receptors caused by the agent being tested.

Thus, the present invention provides methods of screening for drugs or any other agents which can affect a PRO polypeptide-associated disease or disorder. These methods comprise contacting such an agent with an PRO polypeptide or fragment thereof and assaying (I) for the presence of a complex between the agent and the PRO polypeptide or fragment, or (ii) for the presence of a complex between the PRO polypeptide or fragment and the cell, by methods well known in the art. In such competitive binding assays, the PRO polypeptide or fragment is typically labeled. After suitable incubation, free PRO polypeptide or fragment is separated from that present in bound form, and the amount of free or uncomplexed label is a measure of the ability of the particular agent to bind to PRO polypeptide or to interfere with the PRO polypeptide/cell complex.

Another technique for drug screening provides high throughput screening for compounds having suitable binding affinity to a polypeptide and is described in detail in WO 84/03564, published on Sep. 13, 1984. Briefly stated, large numbers of different small peptide test compounds are synthesized on a solid substrate, such as plastic pins or some other surface. As applied to a PRO polypeptide, the peptide test compounds are reacted with PRO polypeptide and washed. Bound PRO polypeptide is detected by methods well known in the art. Purified PRO polypeptide can also be coated directly onto plates for use in the aforementioned drug screening techniques. In addition, non-neutralizing antibodies can be used to capture the peptide and immobilize it on the solid support.

This invention also contemplates the use of competitive drug screening assays in which neutralizing antibodies capable of binding PRO polypeptide specifically compete with a test compound for binding to PRO polypeptide or fragments thereof. In this manner, the antibodies can be used to detect the presence of any peptide which shares one or more antigenic determinants with PRO polypeptide.

6.14. Example 14

Rational Drug Design

The goal of rational drug design is to produce structural analogs of biologically active polypeptide of interest (i.e., a PRO polypeptide) or of small molecules with which they interact, e.g., agonists, antagonists, or inhibitors. Any of these examples can be used to fashion drugs which are more active or stable forms of the PRO polypeptide or which enhance or interfere with the function of the PRO polypeptide in vivo (cf., Hodgson, *Bio/Technology*, 2: 19–21 (1991)).

In one approach, the three-dimensional structure of the PRO polypeptide, or of an PRO polypeptide-inhibitor complex, is determined by x-ray crystallography, by computer modeling or, most typically, by a combination of the two approaches. Both the shape and charges of the PRO polypeptide must be ascertained to elucidate the structure and to determine active site(s) of the molecule. Less often, useful information regarding the structure of the PRO polypeptide may be gained by modeling based on the structure of homologous proteins. In both cases, relevant structural information is used to design analogous PRO polypeptide-like molecules or to identify efficient inhibitors. Useful examples of rational drug design may include molecules which have improved activity or stability as shown by Braxton and Wells, *Biochemistry*, 31:7796–7801 (1992) or which act as inhibitors, agonists, or antagonists of native peptides as shown by Athauda et al., *J. Biochem.*, 113: 742–746 (1993).

It is also possible to isolate a target-specific antibody, selected by functional assay, as described above, and then to solve its crystal structure. This approach, in principle, yields a pharmacore upon which subsequent drug design can be based. It is possible to bypass protein crystallography altogether by generating anti-idiotypic antibodies (anti-ids) to a functional, pharmacologically active antibody. As a mirror image of a mirror image, the binding site of the anti-ids would be expected to be an analog of the original receptor. The anti-id could then be used to identify and isolate peptides from banks of chemically or biologically produced peptides. The isolated peptides would then act as the pharmacore.

By virtue of the present invention, sufficient amounts of the PRO polypeptide may be made available to perform such analytical studies as X-ray crystallography. In addition, knowledge of the PRO polypeptide amino acid sequence provided herein will provide guidance to those employing computer modeling techniques in place of or in addition to x-ray crystallography.

6.15. Example 15

Stimulation of Endothelial Cell Proliferation (Assay 8)

This assay is designed to determine whether PRO polypeptides of the present invention show the ability to stimulate adrenal cortical capillary endothelial cell (ACE) growth. PRO polypeptides testing positive in this assay would be expected to be useful for the therapeutic treatment of conditions or disorders where angiogenesis would be beneficial including, for example, wound healing, and the like (as would agonists of these PRO polypeptides). Antagonists of the PRO polypeptides testing positive in this assay would be expected to be useful for the therapeutic treatment of cancerous tumors.

Bovine adrenal cortical capillary endothelial (ACE) cells (from primary culture, maximum of 12–14 passages) were plated in 96-well plates at 500 cells/well per 100 microliter. Assay media included low glucose DMEM, 10% calf serum, 2 mM glutamine, and 1× penicillin/streptomycin/fungizone. Control wells included the following: (1) no ACE cells added; (2) ACE cells alone; (3) ACE cells plus VEGF (5 ng/ml); and (4) ACE cells plus FGF (5 ng/ml). The control or test sample, (in 100 microliter volumes), was then added to the wells (at dilutions of 1%, 0.1% and 0.01%, respectively). The cell cultures were incubated for 6–7 days at 37° C./5% $CO_2$. After the incubation, the media in the wells was aspirated, and the cells were washed 1X with PBS. An acid phosphatase reaction mixture (100 microliter; 0.1M sodium acetate, pH 5.5, 0.1% Triton X-100, 10 mM p-nitrophenyl phosphate) was then added to each well. After a 2 hour incubation at 37° C., the reaction was stopped by addition of 10 microliters 1N NaOH. Optical density (OD) was measured on a microplate reader at 405 nm.

The activity of a PRO polypeptide was calculated as the fold increase in proliferation (as determined by the acid phosphatase activity, OD 405 nm) relative to (1) cell only background, and (2) relative to maximum stimulation by VEGF. VEGF (at 3–10 ng/ml) and FGF (at 1–5 ng/ml) were employed as an activity reference for maximum stimulation. Results of the assay were considered "positive" if the observed stimulation was 250% increase over background. VEGF (5 ng/ml) control at 1% dilution gave 1.24 fold stimulation; FGF (5 ng/ml) control at 1% dilution gave 1.46 fold stimulation.

PRO21 tested positive in this assay.

6.16. Example 16

Inhibition of Vascular Endothelial Growth Factor (VEGF) Stimulated Proliferation of Endothelial Cell Growth (Assay 9)

The ability of various PRO polypeptides to inhibit VEGF stimulated proliferation of endothelial cells was tested. Polypeptides testing positive in this assay are useful for inhibiting endothelial cell growth in mammals where such an effect would be beneficial, e.g., for inhibiting tumor growth.

Specifically, bovine adrenal cortical capillary endothelial cells (ACE) (from primary culture, maximum of 12–14 passages) were plated in 96-well plates at 500 cells/well per 100 microliter. Assay media included low glucose DMEM, 10% calf serum, 2 mM glutamine, and 1× penicillin/streptoinycin/fungizone. Control wells included the following: (1) no ACE cells added; (2) ACE cells alone; (3) ACE cells plus 5 ng/ml FGF; (4) ACE cells plus 3 ng/ml VEGF; (5) ACE cells plus 3 ng/ml VEGF plus 1 ng/ml TGF-beta; and (6) ACE cells plus 3 ng/ml VEGF plus 5 ng/ml LIF. The test samples, poly-his tagged PRO polypeptides (in 100 microliter volumes), were then added to the wells (at dilutions of 1%, 0.1% and 0.01%, respectively). The cell cultures were incubated for 6–7 days at 37° C./5% $CO_2$. After the incubation, the media in the wells was aspirated, and the cells were washed 1× with PBS. An acid phosphatase reaction mixture (100 microliter; 0.1M sodium acetate, pH 5.5, 0.1% Triton X-100, 10 mM p-nitrophenyl phosphate) was then added to each well. After a 2 hour incubation at 37° C., the reaction was stopped by addition of 10 microliters 1N NaOH. Optical density (OD) was measured on a microplate reader at 405 nm.

The activity of PRO polypeptides was calculated as the percent inhibition of VEGF (3 ng/ml) stimulated proliferation (as determined by measuring acid phosphatase activity at OD 405 nm) relative to the cells without stimulation. TGF-beta was employed as an activity reference at 1 ng/ml, since TGF-beta blocks 70–90% of VEGF-stimulated ACE cell proliferation. The results are indicative of the utility of the PRO polypeptides in cancer therapy and specifically in inhibiting tumor angiogenesis. Numerical values (relative inhibition) are determined by calculating the percent inhibition of VEGF stimulated proliferation by the PRO polypeptides relative to cells without stimulation and then dividing that percentage into the percent inhibition obtained by TGF-β at 1 ng/ml which is known to block 70–90% of VEGF stimulated cell proliferation. The results are considered positive if the PRO polypeptide exhibits 30% or greater inhibition of VEGF stimulation of endothelial cell growth (relative inhibition 30% or greater).

PRO247, PRO720 and PRO4302 tested positive in this assay.

6.17. Example 17

Enhancement of Heart Neonatal Hypertrophy Induced by LIF+ET-1 (Assay 75)

This assay is designed to determine whether PRO polypeptides of the present invention show the ability to enhance neonatal heart hypertrophy induced by LIF and endothelin-1 (ET-1). A test compound that provides a positive response in the present assay would be useful for the therapeutic treatment of cardiac insufficiency diseases or disorders characterized or associated with an undesired level of hypertrophy of the cardiac muscle.

Cardiac myocytes from 1-day old Harlan Sprague Dawley rats (180 μl at $7.5\times10^4$/ml, serum <0.1, freshly isolated) are introduced on day 1 to 96-well plates previously coated with DMEM/F12+4%FCS. Test PRO polypeptide samples or growth medium alone (negative control) are then added directly to the wells on day 2 in 20 μl volume. LIF+ET-1 are then added to the wells on day 3. The cells are stained after an additional 2 days in culture and are then scored visually the next day. A positive in the assay occurs when the PRO polypeptide treated myocytes obtain a score greater than zero. A score of zero represents non-responsive cells whereas scores of 1 or 2 represent enhancement (i.e. they are visually larger on the average or more numerous than the untreated myocytes).

PRO21 polypeptides tested positive in this assay.

6.18. Example 18

Detection of Endothelial Cell Apoptosis (FACS) (Assay 96)

The ability of PRO polypeptides of the present invention to induce apoptosis in endothelial cells was tested in human venous umbilical vein endothelial cells (HUVEC, Cell Systems) in gelatinized T175 flasks using HUVEC cells below passage 10. PRO polypeptides testing positive in this assay are expected to be useful for therapeutically treating conditions where apoptosis of endothelial cells would be beneficial including, for example, the therapeutic treatment of tumors.

On day one, the cells were split [420,000 cells per gelatinized 6 cm dishes—($11\times10^3$ cells/cm$^2$ Falcon, Primaria)] and grown in media containing serum (CS-C, Cell System) overnight or for 16 hours to 24 hours.

On day 2, the cells were washed 1× with 5 ml PBS; 3 ml of 0% serum medium was added with VEGF (100 ng/ml); and 30 μl of the PRO test compound (final dilution 1%) or 0% serum medium (negative control) was added. The mixtures were incubated for 48 hours before harvesting.

The cells were then harvested for FACS analysis. The medium was aspirated and the cells washed once with PBS. 5 ml of 1× trypsin was added to the cells in a T-175 flask, and the cells were allowed to stand until they were released from the plate (about 5–10 minutes). Trypsinization was stopped by adding 5 ml of growth media. The cells were spun at 1000 rpm for 5 minutes at 4° C. The media was aspirated and the cells were resuspended in 10 ml of 10% serum complemented medium (Cell Systems), 5 μl of Annexin-FITC (BioVison) added and chilled tubes were submitted for FACS. A positive result was determined to be enhanced apoptosis in the PRO polypeptide treated samples as compared to the negative control.

PRO4302 polypeptide tested positive in this assay.

6.19. Example 19

Induction of c-fos in HUVEC Cells (Assay 123)

This assay is designed to determine whether PRO polypeptides show the ability to induce c-fos in HUVEC cells. PRO polypeptides testing positive in this assay would be expected to be useful for the therapeutic treatment of conditions or disorders where angiogenesis would be beneficial including, for example, wound healing, and the like (as would agonists of these PRO polypeptides). Antagonists of the PRO polypeptides testing positive in this assay would be expected to be useful for the therapeutic treatment of cancerous tumors.

Human venous umbilical vein endothelial cells (HUVEC, Cell Systems) in growth media (50% Ham's F12 w/o GHT: low glucose, and 50% DMEM without glycine: with NaHCO3, 1% glutamine, 10 mM HEPES, 10% FBS, 10 ng/ml bFGF) were plated on 96-well microtiter plates at a cell density of $5\times10^3$ cells/well. The day after plating (day 2), the cells were starved for 24 hours by removing the growth media and replacing with serum free media. On day 3, the cells are treated with 100 μl/well test samples and controls (positive control=growth media; negative control=Protein 32 buffer=10 mM HEPES, 140 mM NaCl, 4% (w/v) mannitol, pH 6.8). One plate of cells was incubated for 30 minutes at 37° C., in 5% $CO_2$. Another plate of cells was incubated for 60 minutes at 37° C., in 5% $CO_2$. The samples were removed, and RNA was harvested using the RNeasy 96 kit (Qiagen). Next, the RNA was assayed for c-fos, egr-1 and GAPDH induction using Taqman.

The measure of activity of the fold increase over the negative control (Protein 32/HEPES buffer described above) value was by obtained by calculating the fold increase of the ratio of c-fos to GAPDH in test samples as compared to the negative control. The results are considered positive if the PRO polypeptide exhibits at least a two-fold value over the negative buffer control.

PRO1376 polypeptide tested positive in this assay.

6.20. Example 20

Normal Human Iliac Artery Endothelial Cell Proliferation (Assay 138)

This assay is designed to determine whether PRO polypeptides of the present invention show the ability to modulate proliferation of human iliac artery endothelial cells in culture and, therefore, function as useful growth or inhibitory factors.

On day 0, human iliac artery endothelial cells (from cell lines, maximum of 12–14 passages) were plated in 96-well plates at 1000 cells/well per 100 microliter and incubated overnight in complete media [epithelial cell growth media (EGM, Clonetics), plus supplements: human epithelial growth factor (hEGF), bovine brain extract (BBE), hydrocortisone, GA-1000, and fetal bovine serum (FBS, Clonetics)]. On day 1, complete media was replaced by basal media [EGM plus 1% FBS] and addition of PRO polypeptides at 1%, 0.1% and 0.01%. On day 7, an assessment of cell proliferation was performed by Alamar Blue assay followed by Crystal Violet. Results are expressed as % of the cell growth observed with control buffer.

The following PRO polypeptides stimulated proliferation in this assay: PRO214, PRO256, PRO363, PRO365, PRO791, PRO836, PRO1025, PRO1186, PRO1192, PRO1272, PRO1306, PRO1325, PRO1329, PRO1376, PRO1411, PRO1508, PRO1787, PRO1868, PRO4324, PRO4333, PRO4408, PRO4499, PRO9821, PRO9873, PRO10008, PRO10096, PRO19670, PRO20040, PRO20044 and PRO21384.

The following PRO polypeptides inhibited proliferation in this assay: PRO238, PRO1029, PRO1274, PRO1279, PRO1419, PRO1890, PRO6006 and PRO28631.

6.21. Example 21

Pooled Human Umbilical Vein Endothelial Cell Proliferation (Assay 139)

This assay is designed to determine whether PRO polypeptides of the present invention show the ability to modulate proliferation of pooled human umbilical vein endothelial cells in culture and, therefore, function as useful growth or inhibitory factors.

On day 0, pooled human umbilical vein endothelial cells (from cell lines, maximum of 12–14 passages) were plated in 96-well plates at 1000 cells/well per 100 microliter and incubated overnight in complete media [epithelial cell growth media (EGM, Clonetics), plus supplements: human epithelial growth factor (hEGF), bovine brain extract (BBE), hydrocortisone, GA-1000, and fetal bovine serum (FBS, Clonetics)]. On day 1, complete media was replaced by basal media [EGM plus 1% FBS] and addition of PRO polypeptides at 1%, 0.1% and 0.01%. On day 7, an assessment of cell proliferation was performed by Alamar Blue assay followed by Crystal Violet. Results are expresses as % of the cell growth observed with control buffer.

The following PRO polypeptides stimulated proliferation in this assay: PRO181, PRO205, PRO221, PRO231, PRO238, PRO241, PRO247, PRO256. PRO258, PRO263, PRO265, PRO295, PRO321, PRO322, PRO337, PRO363, PRO533, PRO697, PRO725, PRO771, PRO788, PRO819, PRO828, PRO846, PRO865, PRO1005, PRO1006, PRO1025, PRO1054, PRO1071, PRO1079, PRO1080, PRO1114, PRO1131, PRO1155, PRO1160, PRO1192, PRO1244, PRO1272, PRO1273, PRO1279, PRO1283, PRO1286, PRO1306, PRO1309, PRO1325, PRO1329, PRO1347, PRO1356, PRO1376, PRO1382, PRO1412, PRO1550, PRO1556, PRO1760, PRO1787, PRO1801, PRO1868, PRO1887, PRO3438, PRO3444, PRO4324, PRO4341, PRO4342, PRO4353, PRO4354, PRO4356, PRO4371, PRO4422, PRO4425, PRO5723, PRO5737, PRO6029, PRO6071, PRO10096 and PRO21055.

The following PRO polypeptides inhibited proliferation in this assay: PRO229, PRO444, PRO827, PRO1007, PRO1075, PRO1184, PRO1190, PRO1195, PRO1419, PRO1474, PRO1477, PRO1488, PRO1782, PRO4302, PRO4405, PRO5725, PRO5776, PRO7436, PRO9771, PRO10008 and PRO21384.

6.22. Example 22

Human Coronary Artery Smooth Muscle Cell Proliferation (Assay 140)

This assay is designed to determine whether PRO polypeptides of the present invention show the ability to modulate proliferation of human coronary artery smooth muscle cells in culture and, therefore, function as useful growth or inhibitory factors.

On day 0, human coronary artery smooth muscle cells (from cell lines, maximum of 12–14 passages) were plated in 96-well plates at 1000 cells/well per 100 microliter and incubated overnight in complete media [smooth muscle growth media (SmGM, Clonetics), plus supplements: insulin, human epithelial growth factor (hEGF), human fibroblast growth factor (hFGF), GA-1000, and fetal bovine serum (FBS, Clonetics)]. On day 1, complete media was replaced by basal media [SmGM plus 1% FBS] and addition of PRO polypeptides at 1%, 0.1% and 0.01%. On day 7, an assessment of cell proliferation was performed by Alamar Blue assay followed by Crystal Violet. Results are expresses as % of the cell growth observed with control buffer.

The following PRO polypeptides stimulated proliferation in this assay: PRO162, PRO182, PRO204, PRO221, PRO230, PRO256, PRO258, PRO533, PRO697, PRO725, PRO738, PRO826, PRO836, PRO840, PRO846, PRO865, PRO982, PRO1025, PRO1029, PRO1071, PRO1083, PRO1134, PRO1160, PRO1182, PRO1184, PRO1186, PRO1192, PRO1274, PRO1279, PRO1283, PRO1306, PRO1308, PRO1325, PRO1337, PRO1338, PRO1343, PRO1376, PRO1387, PRO1411, PRO1412, PRO1415, PRO1434, PRO1474, PRO1550, PRO1556, PRO1567, PRO1600, PRO1754, PRO1758, PRO1760, PRO1787, PRO1865, PRO1868, PRO1917, PRO1928, PRO3438, PRO3562, PRO4333, PRO4345, PRO4353, PRO4354, PRO4408, PRO4430, PRO4503, PRO6714, PRO9771, PRO9820, PRO9940, PRO10096, PRO21055, PRO21184 and PRO21366.

The following PRO polypeptides inhibited proliferation in this assay: PRO181, PRO195, PRO1080, PRO1265, PRO1309, PRO1488, PRO4302, PRO4405 and PRO5725.

6.23. Example 23

Microarray Analysis to Detect Overexpression of PRO Polypeptides in HUVEC Cells Treated with Growth Factors This assay is designed to determine whether PRO polypeptides of the present invention show the ability to induce angiogenesis by stimulating endothelial cell tube formation in HUVEC cells.

Nucleic acid microarrays, often containing thousands of gene sequences, are useful for identifying differentially expressed genes in tissues exposed to various stimuli (e.g., growth factors) as compared to their normal, unexposed counterparts. Using nucleic acid microarrays, test and control mRNA samples from test and control tissue samples are reverse transcribed and labeled to generate cDNA probes.

The cDNA probes are then hybridized to an array of nucleic acids immobilized on a solid support. The array is configured such that the sequence and position of each member of the array is known. Hybridization of a labeled probe with a particular array member indicates that the sample from which the probe was derived expresses that gene. If the hybridization signal of a probe from a test (exposed tissue) sample is greater than hybridization signal of a probe from a control (normal, unexposed tissue) sample, the gene or genes overexpressed in the exposed tissue are identified. The implication of this result is that an overexpressed protein in an exposed tissue may be involved in the functional changes within the tissue following exposure to the stimuli (e.g., tube formation).

The methodology of hybridization of nucleic acids and microarray technology is well known in the art. In the present example, the specific preparation of nucleic acids for hybridization and probes, slides, and hybridization conditions are all detailed in U.S. Provisional Patent Application Serial No. 60/193,767, filed on Mar. 31, 2000 and which is herein incorporated by reference.

In the present example, HUVEC cells grown in either collagen gels or fibrin gels were induced to form tubes by the addition of various growth factors. Specifically, collagen gels were prepared as described previously in Yang et al., American J. Pathology, 1999, 155(3):887–895 and Xin et al., American J. Pathology, 2001, 158(3):1111–1120. Following gelation of the HUVEC cells, 1× basal medium containing M199 supplemented with 1% FBS, 1×ITS, 2 mM L-glutamine, 50 µg/ml ascorbic acid, 26.5 mM $NaHCO_3$, 100 U/ml penicillin and 100 U/ml streptomycin was added. Tube formation was elicited by the inclusion in the culture media of either a mixture of phorbol myrsitate acetate (50 nM), vascular endothelial cell growth factor (40 ng/ml) and basic fibroblast growth factor (40 ng/ml) ("PMA growth factor mix") or hepatocyte growth factor (40 ng/ml) and vascular endothelial cell growth factor (40 ng/ml) (HGF/VEGF mix) for the indicated period of time. Fibrin Gels were prepared by suspending Huvec ($4\times10^5$ cells/ml) in M199 containing 1% fetal bovine serum (Hyclone) and human fibrinogen (2.5 mg/ml). Thrombin (50U/ml) was then added to the fibrinogen suspension at a ratio of 1 part thrombin solution:30 parts fibrinogen suspension. The solution was then layered onto 10 cm tissue culture plates (total volume: 15 ml/plate) and allowed to solidify at 37° C. for 20 min. Tissue culture media (10 ml of BM containing PMA (50 nM), bFGF (40 ng/ml) and VEGF (40 ng/ml)) was then added and the cells incubated at 37° C. in 5% $CO_2$ in air for the indicated period of time.

Total RNA was extracted from the HUVEC cells incubated for 0, 4, 8, 24, 40 and 50 hours in the different matrix and media combinations using a TRIzol extraction followed by a second purification using RNAeasy Mini Kit (Qiagen). The total RNA was used to prepare cRNA which was then hybridized to the microarrays.

In the present experiments, nucleic acid probes derived from the herein described PRO polypeptide-encoding nucleic acid sequences were used in the creation of the microarray and RNA from the HUVEC cells described above were used for the hybridization thereto. Pairwise comparisons were made using time 0 chips as a baseline. Three replicate samples were analyzed for each experimental condition and time. Hence there were 3 time 0 samples for each treatment and 3 replicates of each successive time point. Therefore, a 3 by 3 comparison was performed for each time point compared against each time 0 point. This resulted in 9 comparisons per time point. Only those genes that had increased expression in all three non-time-0 replicates in each of the different matrix and media combinations as compared to any of the three time zero replicates were considered positive. Although this stringent method of data analysis does allow for false negatives, it minimizes false positives.

PRO178, PRO195, PRO228, PRO301, PRO302, PRO532, PRO724, PRO730, PRO734, PRO793, PRO871, PRO938, PRO1012, PRO1120, PRO1139, PRO1198, PRO1287, PRO1361, PRO1864, PRO1873, PRO2010, PRO3579, PRO4313, PRO4527, PRO4538, PRO4553, PRO4995, PRO5730, PRO6008, PRO7223, PRO7248 and PRO7261 tested positive in this assay.

6.24. Example 24

In situ Hybridization

In situ hybridization is a powerful and versatile technique for the detection and localization of nucleic acid sequences within cell or tissue preparations. It may be useful, for example, to identify sites of gene expression, analyze the tissue distribution of transcription, identify and localize viral infection, follow changes in specific mRNA synthesis, and aid in chromosome mapping.

In situ hybridization was performed following an optimized version of the protocol by Lu and Gillett, Cell Vision, 1: 169–176 (1994), using PCR-generated $^{33}$P-labeled riboprobes. Briefly, formalin-fixed, paraffin-embedded human tissues were sectioned, deparaffinized, deproteinated in proteinase K (20 g/ml) for 15 minutes at 37° C., and further processed for in situ hybridization as described by Lu and Gillett, supra. A ($^{33}$-P)UTP-labeled antisense riboprobe was generated from a PCR product and hybridized at 55° C. overnight. The slides were dipped in Kodak NTB2™ nuclear track emulsion and exposed for 4 weeks.

6.24.1. $^{33}$P-Riboprobe Synthesis 6.0 µl (125 mCi) of $^{33}$P-UTP (Amersham BF 1002, SA<2000 Ci/mmol) were speed-vacuum dried. To each tube containing dried $^{33}$P-UTP, the following ingredients were added:

2.0 µl 5× transcription buffer
1.0 µl DTT (100 mM)
2.0 µl NTP mix (2.5 mM: 10 µl each of 10 mM GTP, CTP & ATP+10 µl $H_2O$)
1.0 µl UTP (50 µM)
1.0 µl RNAsin
1.0 µl DNA template (1 µg)
1.0 µl $H_2O$
1.0 µl RNA polymerase (for PCR products T3=AS, T7=S, usually)

The tubes were incubated at 37° C. for one hour. A total of 1.0 µl RQ1 DNase was added, followed by incubation at 37° C. for 15 minutes. A total of 90 µl TE (10 mM Tris pH 7.6/1 mM EDTA pH 8.0) was added, and the mixture was pipetted onto DE81 paper. The remaining solution was loaded in a MICROCON-50™ ultrafiltration unit, and spun using program 10 (6 minutes). The filtration unit was inverted over a second tube and spun using program 2 (3 minutes). After the final recovery spin, a total of 100 µl TE was added, then 1 µl of the final product was pipetted on DE81 paper and counted in 6 ml of BIOFLUOR II™.

The probe was run on a TBE/urea gel. A total of 1–3 µl of the probe or 5 µl of RNA Mrk III was added to 3 µl of loading buffer. After heating on a 95° C. heat block for three minutes, the gel was immediately placed on ice. The wells of gel were flushed, and the sample was loaded and run at 180–250 volts for 45 minutes. The gel was wrapped in plastic wrap (SARAN™ brand) and exposed to XAR film with an intensifying screen in a −70° C. freezer one hour to overnight.

6.24.2. $^{33}$P-Hybridization 6.24.2.1. Pretreatment of Frozen Sections

The slides were removed from the freezer, placed on aluminum trays, and thawed at room temperature for 5 minutes. The trays were placed in a 55° C. incubator for five minutes to reduce condensation. The slides were fixed for 10 minutes in 4% paraformaldehyde on ice in the fume hood, and washed in 0.5×SSC for 5 minutes, at room temperature (25 ml 20×SSC+975 ml SQ H$_2$O). After deproteination in 0.5 µg/ml proteinase K for 10 minutes at 37° C. (12.5 µl of 10 mg/ml stock in 250 ml prewarmed RNase-free RNase buffer), the sections were washed in 0.5×SSC for 10 minutes at room temperature. The sections were dehydrated in 70%, 95%, and 100% ethanol, 2 minutes each.

6.24.2.2. Pretreatment of Paraffin-Embedded Sections

The slides were deparaffinized, placed in SQ H$_2$O, and rinsed twice in 2×SSC at room temperature, for 5 minutes each time. The sections were deproteinated in 20 µg/ml proteinase K (500 µl of 10 mg/ml in 250 ml RNase-free RNase buffer; 37° C., 15 minutes) for human embryo tissue, or 8× proteinase K (100 µl in 250 ml Rnase buffer, 37° C., 30 minutes) for formalin tissues. Subsequent rinsing in 0.5×SSC and dehydration were performed as described above.

6.24.2.3. Prehybridization

The slides were laid out in a plastic box lined with Box buffer (4×SSC, 50% formamide)—saturated filter paper. The tissue was covered with 50 µl of hybridization buffer (3.75 g dextran sulfate+6 ml SQ H2O), vortexed, and heated in the microwave for 2 minutes with the cap loosened. After cooling on ice, 18.75 ml formamide, 3.75 ml 20×SSC, and 9 ml SQ H$_2$O were added, and the tissue was vortexed well and incubated at 42° C. for 1–4 hours.

6.24.2.4. Hybridization 1.0×10$^6$ cpm probe and 1.0 µl tRNA (50 mg/ml stock) per slide were heated at 95° C. for 3 minutes. The slides were cooled on ice, and 48 µl hybridization buffer was added per slide. After vortexing, 50 µl $^{33}$P mix was added to 50 µl prehybridization on the slide. The slides were incubated overnight at 55° C.

6.24.2.5. Washes

Washing was done for 2×10 minutes with 2×SSC, EDTA at room temperature (400 ml 20×SSC+16 ml 0.25 M EDTA, V$_f$=4L), followed by RNAseA treatment at 37° C. for 30 minutes (500 µl of 10 mg/ml in 250 ml Rnase buffer=20 µg/ml). The slides were washed 2×10 minutes with 2×SSC, EDTA at room temperature. The stringency wash conditions were as follows: 2 hours at 55° C., 0.1×SSC, EDTA (20 ml 20×SSC+16 ml EDTA, V$_f$=4L).

6.24.2.6. Oligonucleotides

In situ analysis was performed on three of the DNA sequences disclosed herein. The primers used to generate the probes and/or the probes employed for these analyses are as follows:

```
DNA33100-p1:   5'GGA TTC TAA TAC GAC TCA CTA TAG GGC CGG GTG GAG GTG GAA CAG AAA3'        (SEQ ID NO:375)

DNA33100-p2:   5' CTA TGA AAT TAA CCC TCA CTA AAG GGA CAC AGA CAG AGC CCC ATA CGC3'       (SEQ ID NO:376)

DNA34431-p1:   5'GGA TTC TAA TAC GAC TCA CTA TAG GGC CAG GGA AAT CCG GAT GTG TC3'         (SEQ ID NO:377)

DNA34431-p2:   5' CTA TGA AAT TAA CCC TCA CTA AAG GGA GTA AGG GGA TGC CAC CGA GTA3'       (SEQ ID NO:378)

DNA38268-p1:   5'GGA TTC TAA TAC GAC TCA CTA TAG GGC CAG CTA CCC GCA GGA GGA GG3'         (SEQ ID NO:379)

DNA38268-p2:   5'CTA TGA AAT TAA CCC TCA CTA AAG GGA TCC CAG GTG ATG AGG TCC AGA3'        (SEQ ID NO:380)

DNA64908 probe: 5'CCATCTCGGAGACCTTTGTGCAGCGTGTATACCAGCCTTACCTCACCA                          (SEQ ID NO:381)
                CTTGCGACGGACACAGAGCCTGCAGCACCTACCGAACCATCTACCGGAC
                TGCCTATCGCCGTAGCCCTGGGGTGACTCCCGCAAGCCTCGCTATGCTTG
                CTGCCCTGGTTGGAAGAGGACCAGTGGGCTCCCTGGGGCTTGTGGAGCA
                GCAATATGCCAGCCTCCATGTGGGAATGGAGGGAGTTGCATCCGCCCAG
                GACACTGCCGCTGCCCTGTGGGATGGCAGGGAGATACTTGCCAGACAGA
                TGTTGATGAATGCAGTACAGGAGAGGCCAGTTGTCCCCAGCGCTGTGTC
                AATACTGTGGGAAGTTACTGGTGCCAGGGATGGGAGGGAGAAAGCCCAT
                CTGCAGATGGGACGCGCTGCCTGTCTAAGGAGGGGCCCTCCCGGTGGCC
                CCAACCCCACAGCAGGAGTGGACAGCA3'
```

6.24.2.7. Results

In situ analysis was performed and the results from these analyses are as follows:

6.24.2.7.1. DNA33100-1159 (PRO229) (Scavenger-R/CD6 HomologTNF Motif)

A specific positive signal was observed in mononuclear phagocytes (macrophages) of fetal and adult spleen, liver, lymph node and thymus. All other tissues were negative.

6.24.2.7.2. DNA34431-1177 (PRO263) (CD44)

A specific positive signal was observed in human fetal tissues and placenta over mononuclear cells, with strong expression in epithelial cells of the adrenal cortex. All adult tissues were negative.

6.24.2.7.3. DNA38268-1188 (PRO295) (Integrin)

A specific positive signal was observed in human fetal ganglion cells, fetal neurons, adult adrenal medulla and adult neurons. All other tissues were negative.

6.24.2.7.4. DNA64908-1163-1 (PRO1449)

A specific positive signal was observed in the developing vasculature (from E7–E11), in endothelial cells and in progenitors of endothelial cells in wholemount in situ hybridizations of mouse embryos (FIG. 375). Specific expression was also observed in a subset of blood vessels and epidermis from E12 onward. A mouse orthologue of PRO1449 which has about 78% amino acid identity with PRO1449 was used as the probe.

In normal adult tissues, expression was low to absent. When present, expression was confined to the vasculature (FIG. 376). FIG. 376 further shows that highest expression in adult tissues was observed regionally in vessels running within the white matter of the brain. Elevated expression was also observed in vasculature of many inflamed and diseased tissues, including, but not limited to, tumor vasculature.

Following electroporation of the mouse orthologue of PRO1449 into the choroid layer in the eyes of chicken embryos, new vessel formation was observed in the electroporated eye (top right), but not in the control side from the same embryo (top left), or an embryo that was electroporated with a control cDNA (bottom right) (FIG. 377).

6.25. Example 25

Inhibition of basic Fibroblast Growth Factor (bFGF) Stimulated Proliferation of Endothelial Cell Growth The ability of various PRO polypeptides to inhibit bFGF stimulated proliferation of endothelial cells was tested. Polypeptides testing positive in this assay are useful for inhibiting endothelial cell growth in mammals where such an effect would be beneficial, e.g., for inhibiting tumor growth.

Specifically, human venous umbilical vein endothelial cells (HUVEC, Cell Systems) in epithelial cell growth media (EGM, Clonetics) were plated on 96-well microtiter plates at a cell density of $5 \times 10^3$ cells/well in a volume of 100 µl/well. The day after plating (day 2), the cells were starved for 24 hours by removing the growth media and replacing with starving media (M199 supplemented with 1% FBS, 2 mM L-glutamine, 100U/ml pericillin and 100 U/ml streptomycin). On day 5, the cells are treated with either: (1) M1199 with 10% FBS; (2) M199 with 1% FBS; (3) M 199 with 1% FBS and 20 ng/ml bFGF; (4) M 199 with 1% FBS and 20 ng/ml bFGF and PRO polypeptide (500 nM); (5) M199 with 1% FBS and 20 ng/ml bFGF and PRO polypeptide (50 nM); or (6) M199 with 1% FBS and 20 ng/ml bFGF and PRO polypeptide (5 nM). On day 8, an assessment of cell proliferation was performed by Alamar Blue assay. Optical density (OD) was measured on a microplate reader at excitation 530 and emission at 590 nm.

The activity of PRO polypeptides was calculated as the percent inhibition of bFGF stimulated proliferation relative to the cells without stimulation. The results are indicative of the utility of the PRO polypeptides in cancer therapy and specifically in inhibiting tumor angiogenesis. Numerical values (relative inhibition) are determined by calculating the percent inhibition of bFGF stimulated proliferation by the PRO polypeptides relative to cells without stimulation. The results are considered positive if the PRO polypeptide exhibits 30% or greater inhibition of bFEGF stimulation of endothelial cell growth.

PRO5725 tested positive in this assay.

The foregoing written specification is considered to be sufficient to enable one skilled in the art to practice the invention. The present invention is not to be limited in scope by the construct(s) deposited, since the deposited embodiment(s) is/are intended as single illustration(s) of certain aspects of the invention and any constructs that are functionally equivalent are within the scope of this invention. The deposit of material(s) herein does not constitute an admission that the written description herein contained is inadequate to enable the practice of any aspect of the invention, including the best mode thereof, nor is it to be construed as limiting the scope of the claims to the specific illustrations that it represents. Indeed, various modifications of the invention in addition to those shown and described herein will become apparent to those skilled in the art from the foregoing description and fall within the scope of the appended claims.

SEQUENCE LISTING (383 sequences)

SEQ ID NO: 1 - DNA, 1333 bp, Homo sapiens
gcccacgcgtccgatggcgttcacgttcgcggccttctgctacatgctggcgctgctgctcactgccgcgctcatcttcttcgccatttggcacattatagcatttgatgagctgaagactgattacaagaatcctatagaccagtgtaataccctgaatccccttgtactcccagagtacctcatccacgctttcttctgtgtcatgtttctttgtgcagcagagtggcttacactgggtctcaatatgcccctcttggcatatcatatttggaggtatatgagtagaccagtgatgagtggcccaggactctatgaccctacaaccatcatgaatgcagatattctagcatattgtcagaaggaaggatggtgcaaattagctttttatcttctagcatttttttactacctatatggcatgatctatgttttggtgagctcttagaacaacacacagaagaattggtccagttaagtgcatgcaaaaagccaccaaatgaagggattctatccagcaagatcctgtccaagagtagcctgtggaatctgatcagttactttaaaaaatgactccttattttttaaatgtttccacatttttgcttgtggaaagactgttttcatatgttatactcagataaagattttaaatggtattacgtataaattaatataaaatgattacctctggtgttgacaggtttgaacttgcacttcttaaggaacagccataatcctctgaatgatgcattaattactgactgtcctagtacattggaagcttttgtttataggaacttgtagggctcattttggtttcattgaaacagtatctaattataaattagctgtagatatcaggtgcttctgatgaagtgaaaatgtatatctgactagtgggaaacttcatgggtttcctcatctgtcatgtcgatgattatatatggatacatttacaaaaataaaaagcgggaattttcccttcgcttgaatattatccctgtatattgcatgaatgagagatttcccatatttccatcagagtaataaatatacttgctttaattcttaagcataagtaaacatgatataaaaatatatgctgaattacttgtgaagaatgcatttaaagctattttaaatgtgtttttatttgtaagacattacttattaagaaattggttattatgcttactgttctaatctggtggtaaaggtattcttaagaatttgcaggtactacagattttcaaaactgaatgagagaaaattgtataaccatcctgctgttcctttagtgcaatacaataaaactctgaaattaagactc

SEQ ID NO: 2 - protein, 144 aa, Homo sapiens
MAFTFAAFCYMLALLLTAALIFFAIWHIIAFDELKTDYKNPIDQCNTLNPLVLPEYLIHAFFCVMFLCAAEWLTLGLNMPLLAYHIWRYMSRPVMSGPGLYDPTTIMNADILAYCQKEGWCKLAFYLLAFFYYLYGMIYVLVSS

SEQ ID NO: 3 - DNA, 1780 bp, Homo sapiens
ggctcagaggccccactggaccctcggctcttccttggacttcttgtgtgttctgtgagcttcgctggattcagggtcttgggcatcagaggtgagagggtgggaaggtccgccgcgatggggaagccctggctgcgtgcgctacagctgctgctcctgctgggcgcgtcgtgggcgcgggcgggcgccccgcgctgcacctacaccttcgtgctgcccccgcagaagttcacgggcgctgtgtgctggagcggccccgcatccacgcgggcgacgcccgaggccgccaacgccagcgagctggcggcgctgcgcatgcgcgtcggccgccacgaggagctgttacgcgagctgcagaggctggcggcggccgacggcgccgtggccggcgaggtgcgcgcgctgcgcaaggagagccgcggcctgagcgcgcgcctgggccagttgcgcgcgcagctgcagcacgaggcggggcccggggcgggcccgggggcggatctgggggcggagcctgccgcggcgctggcgctgctcggggagcgcgtgctcaacgcgtccgccgaggctcagcgcgcagccgcccggttccaccagctggacgtcaagttccgcgagctggcgcagctcgtcacccagcagagcagtctcatcgcccgcctggagcgcctgtgcccgggaggcgcgggcgggcagcagcaggtcctgccgccacccccactggtgcctgtggttccggtccgtcttgtgggtagcaccagtgacaccagtaggatgctggacccagccccagagccccagagagaccagacccagagacagcaggagcccatggcttctcccatgcctgcaggtcaccctgcggtccccaccaagcctgtgggcccgtggcaggattgtgcagaggcccgccaggcaggccatgaacagagtggagtgtatgaactgcgagtgggccgtcacgtagtgtcagtatggtgtgagcagcaactggagggtggaggctggactgtgatccagcggaggcaagatggttcagtcaacttcttcactacctggcagcactataaggcgggctttgggcggccagacggagaatactggctgggccttgaacccgtgtatcagctgaccagccgtggggaccatgagctgctggttctcctggaggactgggggggccgtggagcacgtgcccactatgatggcttctccctggaacccgagagcgaccactaccgcctgcggcttggccagtaccatggtgatgctggagactctctttcctggcacaatgacaagcccttcagcaccgtggatagggaccgagactcctattctggtaactgtgccctgtaccagcggggaggctggtggtaccatgcctgtgcccactccaacctcaacggtgtgtggcaccacggcggccactaccgaagccgctaccaggatggtgtctactgggctgagtttcgtggtggggcatattctctcaggaaggccgccatgctcattcggcccctgaagctgtgactctgtgttcctctgtcccctaggccctagaggacattggtcagcaggagcccaagttgttctggccacaccttctttgtggctcagtgccaatgtgtcccacagaacttcccactgtggatctgtgaccctgggcgctgaaaatgggacccaggaatcccccccgtcaatatcttggcctcagatggctccccaaggtcattcatatctcggtttgagctcatatcttataataacacaaagtagccac

SEQ ID NO: 4 - protein, 470 aa, Homo sapiens
MGKPWLRALQLLLLLGASWARAGAPRCTYTFVLPPQKFTGAVCWSGPASTRATPEAANASELAALRMRVGRHEELLRELQRLAAADGAVAGEVRALRKESRGLSARLGQLRAQLQHEAGPGAGPGADLGAEPAAALALLGERVLNASAEAQRAAARFHQLDVKFRELAQLVTQQSSLIARLERLCPGGAGGQQQVLPPPPLVPVVPVRLVGSTSDTSRMLDPAPEPQRDQTQRQQEPMASPMPAGHPAVPTKPVGPWQDCAEARQAGHEQSGVYELRVGRHVVSVWCEQQLEGGGWTVIQRRQDGSVNFFTTWQHYKAGFGRPDGEYWLGLEPVYQLTSRGDHELLVLLEDWGGRGARAHYDGFSLEPESDHYRLRLGQYHGDAGDSLSWHNDKPFSTVDRDRDSYSGNCALYQRGGWWYHACAHSNLNGVWHHGGHYRSRYQDGVYWAEFRGGAYSLRKAAMLIRPLKL

SEQ ID NO: 5 - DNA, 1218 bp, Homo sapiens
cccacgcgtccggcgccgtggcctcgcgtccatctttgccgttctctcggacctgtcacaaaggagtcgcgccgccgccgccgccccctccctccggtgggcccgggaggtagagaaagtcagtgccacagcccgaccgcgctgctctgagccctgggcacgcggaacgggagggagtctgagggttggggacgtctgtgagggaggggaacagccgctcgagcctggggcgggcggaccggactggggccggggtaggctctggaaagggcccgggagagaggtggcgttggtcagaacctgagaaacagccgagaggttttccaccgaggcccgcgcttgagggatctgaagaggttcctagaagagggtgttccctctttcgggggtcctcaccagaagaggttcttgggggtcgcccttctgaggaggctgcggctaacagggcccagaactgccattggatgtccagaatcccctgtagttgataatgttgggaataagctctgcaactttctttggcattcagttgttaaaaacaaataggatgcaaattcctcaactccaggttatgaaaacagtacttggaaaactgaaaactacctaaatgatcgtctttggttgggccgtgttcttagcgagcagaagccttggccagggtctgttgttgactctcgaagagcacatagcccacttcctagggactggaggtgccgctactaccatgggtaattcctgtatctgccgagatgacagtggaacagatgacagtgttgacacccaacagcaacaggccgagaacagtgcagtacccactgctgacacaaggagccaaccacgggaccctgttcggccaccaaggaggggccgaggacctcatgagccaaggagaaagaaacaaaatgtggatgggctagtgttggacacactggcagtaatacggactcttgtagataagtaagtatctgactcacggtcacctccagtggaatgaaaagtgttctgcccggaaccatgactttaggactccttcagttcctttaggacatactcgccaagccttgtgctcacagggcaaaggagaatattttaatgctccgctgatggcagagtaaatgataagatttgatgtttttgcttgctgtcatctactttgtctggaaatgtctaaatgtttctgtagcagaaaacacgataaagctatgatctttattagag

SEQ ID NO: 6 - protein, 117 aa, Homo sapiens
MIVFGWAVFLASRSLGQGLLLTLEEHIAHFLGTGGAATTMGNSCICRDDSGTDDSVDTQQQQAENSAVPTADTRSQPRDPVRPPRRGRGPHEPRRKKQNVDGLVLDTLAVIRTLVDK

SEQ ID NO: 7 - DNA, 1174 bp, Homo sapiens
cggacgcgtgggggaaacccttccgagaaaacagcaacaagctgagctgctgtgacagaggggaacaagatggcggcgccgaaggggagcctctgggtgaggacccaactggggctcccgccgctgctgctgctgaccatggccttggccggaggttcggggaccgcttcggctgaagcatttgactcggtcttgggtgatacggcgtcttgccaccgggcctgtcagttgacctaccccttgcacacctaccctaaggaagaggagttgtacgcatgtcagagaggttgcaggctgttttcaatttgtcagtttgtggatgatggaattgacttaaatcgaactaaattggaatgtgaatctgcatgtacagaagcatattcccaatctgatgagcaatatgcttgccatcttggttgccagaatcagctgccattcgctgaactgagacaagaacaacttatgtccctgatgccaaaaatgcacctactctttcctctaactctggtgaggtcattctggagtgacatgatggactccgcacagagcttcataacctcttcatggactttttatcttcaagccgatgacggaaaaatagttatattccagtctaagccagaaatccagtacgcaccacatttggagcaggagcctacaaatttgagagaatcatctctaagcaaaatgtcctatctgcaaatgagaaattcacaagcgcacaggaattttcttgaagatggagaaagtgatggctttttaagatgcctctctcttaactctgggtggattttaactacaactcttgtcctctcggtgatggtattgctttggatttgttgtgcaactgttgctacagctgtggagcagtatgttccctctgagaagctgagtatctatggtgacttggagtttatgaatgaacaaaagctaaacagatatccagcttcttctcttgtggttgttagatctaaaactgaagatcatgaagaagcagggcctctacctacaaaagtgaatcttgctcattctgaaatttaagcatttttcttttaaaagacaagtgtaatagacatctaaaattccactcctcatagagcttttaaaatggtttcattggatataggccttaagaaatcactataaaatgcaaataaagttactcaaatctgtg

SEQ ID NO: 8 - protein, 323 aa, Homo sapiens
MAAPKGSLWVRTQLGLPPLLLLTMALAGGSGTASAEAFDSVLGDTASCHRACQLTYPLHTYPKEEELYACQRGCRLFSICQFVDDGIDLNRTKLECESACTEAYSQSDEQYACHLGCQNQLPFAELRQEQLMSLMPKMHLLFPLTLVRSFWSDMMDSAQSFITSSWTFYLQADDGKIVIFQSKPEIQYAPHLEQEPTNLRESSLSKMSYLQMRNSQAHRNFLEDGESDGFLRCLSLNSGWILTTTLVLSVMVLLWICCATVATAVEQYVPSEKLSIYGDLEFMNEQKLNRYPASSLVVVRSKTEDHEEAGPLPTKVNLAHSEI

SEQ ID NO: 9 - DNA, 715 bp, Homo sapiens
tatttaccatatcagattcacattcagtcctcagcaaaatgaagggctccattttcactctgtttttattctctgtcctatttgccatctcagaagtgcggagcaaggagtctgtgagactctgtgggctagaatacatacggacagtcatctatatctgtgctagctccaggtggagaaggcatctggaggggatccctcaagctcagcaagctgagacaggaaactccttccagctcccacataaacgtgagttttctgaggaaaatccagcgcaaaaccttccgaaggtggatgcctcaggggaagaccgtctttggggtggacagatgcccactgaagagctttggaagtcaaagaagcattcagtgatgtcaagacaagatttacaaactttgtgttgcactgatggctgttccatgactgatttgagtgctctttgctaagacaagagcaaatacccaatgggtggcagagctttatcacatgtttaattacagtgttttactgcctggtagaacactaatattgtgttattaaaatgatggcttttgggtaggcaaaacttcttttctaaaaggtatagctgagcggttgaaaccacagtgatctctattttctccctttgccaaggttaatgaactgttcttttcaaattctactaatgctttgaaatttcaaatgctgcgcaaaattgcaataaaaatgctataaa

SEQ ID NO: 10 - protein, 135 aa, Homo sapiens
MKGSIFTLFLFSVLFAISEVRSKESVRLCGLEYIRTVIYICASSRWRRHLEGIPQAQQAETGNSFQLPHKREFSEENPAQNLPKVDASGEDRLWGGQMPTEELWKSKKHSVMSRQDLQTLCCTDGCSMTDLSALC

SEQ ID NO: 11 - DNA, 1434 bp, Homo sapiens
cccacgcgtccggacaaactggaggtgaaaggagctggtactgtccactgtgctgtcggtgctgaacctgagacgcgagcggaccagttgctccagcacctgaaggcaacgccctcttgcaccctctgtgccctgtgggacccgcttcaccaacaggacccatatcaacttgacaaaggagtgtggtatcggacgtgggagagagtcctctgtttgccacctgggcgctcattcaggcgtgactttggagatttctatagttttagaccaaactatttttttttccccagctaagacgatcttttgagagtttttttttttattgtgatttatatttccacagcgtttaggaatctttctgggggacttttgtgactgttaaaataaggtgaaaagcaataaggatgtttaagtgctggtcagttgtcttggttctcggattcatttttctggagtcggaaggaaggccaaccaaagaaggaggatatggccttaaatcctatcagcctctaatgagattgcgacataagcaggaaaaaaatcaagaaagttcaagagtcaaaggatttatgattcaggatggcccttttggatcttgtgaaaataagtactgtggtttgggaagacactgtgttaccagcagagagacagggcaagcagaatgtgcctgtatggacctttgcaaacgtcactacaaacctgtgtgtggatctgacggagaattctatgaaaaccactgtgaagtgcacagagctgcttgcctgaaaaaacaaaagattaccattgttcacaatgaagactgcttctttaaaggagataagtgcaagactactgaatacagcaagatgaaaaatatgctattagatttacaaaatcaaaaatatattatgcaagaaaatgaaaatcctaatggcgacgacatatctcggaagaagctattggtggatcaaatgtttaaatattttgatgcagacagtaatggacttgtagatattaatgaactaactcaggtgataaaacaggaagaacttggcaaggatctctttgattgtactttgtatgttctattgaaatatgatgattttaatgctgacaagcacctggctcttgaagaattttatagagcattccaagtgatccagttgagtctgccagaagatcagaaactaagcatcactgcagcaactgtgggacaaagtgctgttctgagctgtgccattcaaggaaccctgagacctcccattatctggaaaaggaacaatattattctaaataatttagatttggaagacatcaatgactttggagatgatgggtccttgtatattactaaggttaccacaactcacgttggcaattacacctgctatgcagatggctatgaacaagtctatcagactcacatcttccaagtgaatgttcctccagtcatcc

SEQ ID NO: 12 - protein, 343 aa, Homo sapiens
MFKCWSVVLVLGFIFLESEGRPTKEGGYGLKSYQPLMRLRHKQEKNQESSRVKGFMIQDGPFGSCENKYCGLGRHCVTSRETGQAECACMDLCKRHYKPVCGSDGEFYENHCEVHRAACLKKQKITIVHNEDCFFKGDKCKTTEYSKMKNMLLDLQNQKYIMQENENPNGDDISRKKLLVDQMFKYFDADSNGLVDINELTQVIKQEELGKDLFDCTLYVLLKYDDFNADKHLALEEFYRAFQVIQLSLPEDQKLSITAATVGQSAVLSCAIQGTLRPPIIWKRNNIILNNLDLEDINDFGDDGSLYITKVTTTHVGNYTCYADGYEQVYQTHIFQVNVPPVI

SEQ ID NO: 13 - DNA, 1788 bp, Homo sapiens
tgccgggctgcggggcgccttgactctccctccaccctgcctcctcgggctccactcgtctgcccctggactcccgtctcctcctgtcctccggcttcccagagctccctccttatggcagcagcttcccgcgtctccggcgcagcttctcagcggacgaccctctcgctccggggctgagcccagtccctggatgttgctgaaactctcgagatcatgcgcgggtttggctgctgcttccccgccgggtgccactgccaccgccgccgcctctgctgccgccgtccgcgggatgctcagtagcccgctgcccggcccccgcgatcctgtgttcctcggaagccgtttgctgctgcagagttgcacgaactagtcatggtgctgtgggagtccccgcggcagtgcagcagctggacactttgcgagggcttttgctggctgctgctgctgcccgtcatgctactcatcgtagcccgcccggtgaagctcgctgctttccctacctccttaagtgactgccaaacgcccaccggctggaattgctctggttatgatgacagagaaaatgatctcttcctctgtgacaccaacacctgtaaatttgatggggaatgtttaagaattggagacactgtgacttgcgtctgtcagttcaagtgcaacaatgactatgtgcctgtgtgtggctccaatggggagagctaccagaatgagtgttacctgcgacaggctgcatgcaaacagcagagtgagatacttgtggtgtcagaaggatcatgtgccacagatgcaggatcaggatctggagatggagtccatgaaggctctggagaaactagtcaaaaggagacatccacctgtgatatttgccagtttggtgcagaatgtgacgaagatgccgaggatgtctggtgtgtgtgtaatattgactgttctcaaaccaacttcaatcccctctgcgcttctgatgggaaatcttatgataatgcatgccaaatcaaagaagcatcgtgtcagaaacaggagaaaattgaagtcatgtctttgggtcgatgtcaagataacacaactacaactactaagtctgaagatgggcattatgcaagaacagattatgcagagaatgctaacaaattagaagaaagtgccagagaacaccacataccttgtccggaacattacaatggcttctgcatgcatgggaagtgtgagcattctatcaatatgcaggagccatcttgcaggtgtgatgctggttatactggacaacactgtgaaaaaaaggactacagtgttctatacgttgttcccggtcctgtacgatttcagtatgtcttaatcgcagctgtgattggaacaattcagattgctgtcatctgtgtggtggtcctctgcatcacaaggaaatgccccagaagcaacagaattcacagacagaagcaaaatacagggcactacagttcagacaatacaacaagagcgtccacgaggttaatctaaagggagcatgtttcacagtggctggactaccgagagcttggactacacaatacagtattatagacaaaagaataagacaagagatctacacatgttgccttgcatttgtggtaatctacaccaatgaaaacatgtactacagctatatttgattatgtatggatatatttgaaatagtatacattgtcttgatgttttttctgtaatgtaaataaactatttatatcacacaatatagttttttctttcccatgtatttgttatatataataaatactcagtgatgag

SEQ ID NO: 14 - protein, 374 aa, Homo sapiens
MVLWESPRQCSSWTLCEGFCWLLLLPVMLLIVARPVKLAAFPTSLSDCQTPTGWNCSGYDDRENDLFLCDTNTCKFDGECLRIGDTVTCVCQFKCNNDYVPVCGSNGESYQNECYLRQAACKQQSEILVVSEGSCATDAGSGSGDGVHEGSGETSQKETSTCDICQFGAECDEDAEDVWCVCNIDCSQTNFNPLCASDGKSYDNACQIKEASCQKQEKIEVMSLGRCQDNTTTTTKSEDGHYARTDYAENANKLEESAREHHIPCPEHYNGFCMHGKCEHSINMQEPSCRCDAGYTGQHCEKKDYSVLYVVPGPVRFQYVLIAAVIGTIQIAVICVVVLCITRKCPRSNRIHRQKQNTGHYSSDNTTRASTRLI

SEQ ID NO: 15 - DNA, 1475 bp, Homo sapiens
ggagctcagcccagtgggcagtctgaagatggccaattacacgctggcaccagaggatgaatatgatgtcctcatagaaggtgaactggagagcgatgaggcagagcaatgtgacaagtatgacgcccaggcactctcagcccagctggtgccatcactctgctctgctgtgtttgtgatcggtgtcctggacaatctcctggttgtgcttatcctggtaaaatataaaggactcaaacgcgtggaaaatatctatcttctaaacttggcagtttctaacttgtgtttcttgcttaccctgcccttctgggctcatgctgggggcgatcccatgtgtaaaattctcattggactgtacttcgtgggcctgtacagtgagacatttttcaattgccttctgactgtgcaaaggtacctagtgtttttgcacaagggcaactttttctcagccaggaggagggtgccctgtggcatcattacaagtgtcctggcatgggtaacagccattctggccactttgcctgaatacgtggtttataaacctcagatggaagaccagaaatacaagtgtgcatttagcagaactcccttcctgccagctgatgagacattctggaagcattttctgactttaaaaatgaacatttcggttcttgtcctccccctatttatttttacatttctctatgtgcaaatgagaaaaacactaaggttcagggagcagaggtatagccttttcaagcttgtttttgccataatggtagtcttccttctgatgtgggcgccctacaatattgcatttttcctgtccactttcaaagaacacttctccctgagtgactgcaagagcagctacaatctggacaaaagtgttcacatcactaaactcatcgccaccacccactgctgcatcaaccctctcctgtatgcgtttcttgatgggacatttagcaaatacctctgccgctgtttccatctgcgtagtaacaccccacttcaacccagggggcagtctgcacaaggcacatcgagggaagaacctgaccattccaccgaagtgtaaactagcatccaccaaatgcaagaagaataaacatggattttcatctttctgcattatttcatgtaaattttctacacatttgtatacaaaatcggatacaggaagaaaagggagaggtgagctaacatttgctaagcactgaatttgtctcaggcaccgtgcaaggctctttacaaacgtgagctccttcgcctcctaccacttgtccatagtgtggataggactagtctcatttctctgagaagaaaactaaggcgcggaaatttgtctaagatcacataactaggaagtggcagaactgattctccagccctggtagcatttgctcagagcctacgcttggtccagaacatcaaactccaaaccctggggacaaacgacatgaaataaatgtattttaaaacatctaaaa

SEQ ID NO: 16 - protein, 344 aa, Homo sapiens
MANYTLAPEDEYDVLIEGELESDEAEQCDKYDAQALSAQLVPSLCSAVFVIGVLDNLLVVLILVKYKGLKRVENIYLLNLAVSNLCFLLTLPFWAHAGGDPMCKILIGLYFVGLYSETFFNCLLTVQRYLVFLHKGNFFSARRRVPCGIITSVLAWVTAILATLPEYVVYKPQMEDQKYKCAFSRTPFLPADETFWKHFLTLKMNISVLVLPLFIFTFLYVQMRKTLRFREQRYSLFKLVFAIMVVFLLMWAPYNIAFFLSTFKEHFSLSDCKSSYNLDKSVHITKLIATTHCCINPLLYAFLDGTFSKYLCRCFHLRSNTPLQPRGQSAQGTSREEPDHSTEV

SEQ ID NO: 17 - DNA, 1838 bp, Homo sapiens
cggacgcgtgggcggacgcgtgggcggcccacggcgcccgcgggctggggcggtcgcttcttccttctccgtggcctacgagggtccccagcctgggtaaagatggccccatggcccccgaagggcctagtcccagctgtgctctggggcctcagcctcttcctcaacctcccaggacctatctggctccagccctctccacctccccagtcttctcccccgcctcagccccatccgtgtcatacctgccggggactggttgacagctttaacaagggcctggagagaaccatccgggacaactttggaggtggaaacactgcctgggaggaagagaatttgtccaaatacaaagacagtgagacccgcctggtagaggtgctggagggtgtgtgcagcaagtcagacttcgagtgccaccgcctgctggagctgagtgaggagctggtggagagctggtggtttcacaagcagcaggaggccccggacctcttccagtggctgtgctcagattccctgaagctctgctgccccgcaggcaccttcgggccctcctgccttccctgtcctgggggaacagagaggccctgcggtggctacgggcagtgtgaaggagaagggacacgagggggcagcgggcactgtgactgccaagccggctacgggggtgaggcctgtggccagtgtggccttggctactttgaggcagaacgcaacgccagccatctggtatgttcggcttgttttggcccctgtgcccgatgctcaggacctgaggaatcaaactgtttgcaatgcaagaagggctgggccctgcatcacctcaagtgtgtagacattgatgagtgtggcacagagggagccaactgtggagctgaccaattctgcgtgaacactgagggctcctatgagtgccgagactgtgccaaggcctgcctaggctgcatgggggcagggccaggtcgctgtaagaagtgtagccctggctatcagcaggtgggctccaagtgtctcgatgtggatgagtgtgagacagaggtgtgtccgggagagaacaagcagtgtgaaaacaccgagggcggttatcgctgcatctgtgccgagggctacaagcagatggaaggcatctgtgtgaaggagcagatcccagagtcagcaggcttcttctcagagatgacagaagacgagttggtggtgctgcagcagatgttctttggcatcatcatctgtgcactggccacgctggctgctaagggcgacttggtgttcaccgccatcttcattggggctgtggcggccatgactggctactggttgtcagagcgcagtgaccgtgtgctggagggcttcatcaagggcagataatcgcggccaccacctgtaggacctcctcccacccacgctgcccccagagcttgggctgccctcctgctggacactcaggacagcttggtttatttttgagagtggggtaagcacccctacctgccttacagagcagcccaggtacccaggcccgggcagacaaggcccctggggtaaaaagtagccctgaaggtggataccatgagctcttcacctggcggggactggcaggcttcacaatgtgtgaatttcaaaagtttttccttaatggtggctgctagagctttggcccctgcttaggattaggtggtcctcacaggggtggggccatcacagctccctcctgccagctgcatgctgccagttcctgttctgtgttcaccacatccccacaccccattgccacttatttattcatctcaggaaataaagaaaggtcttggaaagttaaaaaaaaaaaaaaaaaaaaaaaa

SEQ ID NO: 18 - protein, 420 aa, Homo sapiens
MAPWPPKGLVPAVLWGLSLFLNLPGPIWLQPSPPPQSSPPPQPHPCHTCRGLVDSFNKGLERTIRDNFGGGNTAWEEENLSKYKDSETRLVEVLEGVCSKSDFECHRLLELSEELVESWWFHKQQEAPDLFQWLCSDSLKLCCPAGTFGPSCLPCPGGTERPCGGYGQCEGEGTRGGSGHCDCQAGYGGEACGQCGLGYFEAERNASHLVCSACFGPCARCSGPEESNCLQCKKGWALHHLKCVDIDECGTEGANCGADQFCVNTEGSYECRDCAKACLGCMGAGPGRCKKCSPGYQQVGSKCLDVDECETEVCPGENKQCENTEGGYRCICAEGYKQMEGICVKEQIPESAGFFSEMTEDELVVLQQMFFGIIICALATLAAKGDLVFTAIFIGAVAAMTGYWLSERSDRVLEGFIKGR

SEQ ID NO: 19 - DNA, 1305 bp, Homo sapiens
gcccgggactggcgcaaggtgcccaagcaaggaaagaaataatgaagagacacatgtgttagctgcagccttttgaaacacgcaagaaggaaatcaatagtgtggacagggctggaacctttaccacgcttgttggagtagatgaggaatgggctcgtgattatgctgacattccagcatgaatctggtagacctgtggttaacccgttccctctccatgtgtctcctcctacaaagttttgttcttatgatactgtgctttcattctgccagtatgtgtcccaagggctgtctttgttcttcctctgggggtttaaatgtcacctgtagcaatgcaaatctcaaggaaatacctagagatcttcctcctgaaacagtcttactgtatctggactccaatcagatcacatctattcccaatgaaatttttaaggacctccatcaactgagagttctcaacctgtccaaaaatggcattgagtttatcgatgagcatgccttcaaaggagtagctgaaaccttgcagactctggacttgtccgacaatcggattcaaagtgtgcacaaaaatgccttcaataacctgaaggccagggccagaattgccaacaacccctggcactgcgactgtactctacagcaagttctgaggagcatggcgtccaatcatgagacagcccacaacgtgatctgtaaaacgtccgtgttggatgaacatgctggcagaccattcctcaatgctgccaacgacgctgacctttgtaacctccctaaaaaaactaccgattatgccatgctggtcaccatgtttggctggttcactatggtgatctcatatgtggtatattatgtgaggcaaaatcaggaggatgcccggagacacctcgaatacttgaaatccctgccaagcaggcagaagaaagcagatgaacctgatgatattagcactgtggtatagtgtccaaactgactgtcattgagaaagaaagaaagtagtttgcgattgcagtagaaataagtggtttacttctcccatccattgtaaacatttgaaactttgtatttcagttttttttgaattatgccactgctgaacttttaacaaacactacaacataaataatttgagtttaggtgatccaccccttaattgtacccccgatggtatatttctgagtaagctactatctgaacattagttagatccatctcactatttaataatgaaatttatttttttaatttaaaagcaaataaaagcttaactttgaaccatgggaaaaaaaaaaaaaaaaaaaaaaaaca

SEQ ID NO: 20 - protein, 259 aa, Homo sapiens
MNLVDLWLTRSLSMCLLLQSFVLMILCFHSASMCPKGCLCSSSGGLNVTCSNANLKEIPRDLPPETVLLYLDSNQITSIPNEIFKDLHQLRVLNLSKNGIEFIDEHAFKGVAETLQTLDLSDNRIQSVHKNAFNNLKARARIANNPWHCDCTLQQVLRSMASNHETAHNVICKTSVLDEHAGRPFLNAANDADLCNLPKKTTDYAMLVTMFGWFTMVISYVVYYVRQNQEDARRHLEYLKSLPSRQKKADEPDDISTVV

SEQ ID NO: 21 - DNA, 2822 bp, Homo sapiens
cgccaccactgcggccaccgccaatgaaacgcctcccgctcctagtggttttttccactttgttgaattgttcctatactcaaaattgcaccaagacaccttgtctcccaaatgcaaaatgtgaaatacgcaatggaattgaagcctgctattgcaacatgggattttcaggaaatggtgtcacaatttgtgaagatgataatgaatgtggaaatttaactcagtcctgtggcgaaaatgctaattgcactaacacagaaggaagttattattgtatgtgtgtacctggcttcagatccagcagtaaccaagacaggtttatcactaatgatggaaccgtctgtatagaaaatgtgaatgcaaactgccatttagataatgtctgtatagctgcaaatattaataaaactttaacaaaaatcagatccataaaagaacctgtggctttgctacaagaagtctatagaaattctgtgacagatctttcaccaacagatataattacatatatagaaatattagctgaatcatcttcattactaggttacaagaacaacactatctcagccaaggacaccctttctaactcaactcttactgaatttgtaaaaaccgtgaataattttgttcaaagggatacatttgtagtttgggacaagttatctgtgaatcataggagaacacatcttacaaaactcatgcacactgttgaacaagctactttaaggatatcccagagcttccaaaagaccacagagtttgatacaaattcaacggatatagctctcaaagttttcttttttgattcatataacatgaaacatattcatcctcatatgaatatggatggagactacataaatatatttccaaagagaaaagctgcatatgattcaaatggcaatgttgcagttgcatttttatattataagagtattggtcctttgctttcatcatctgacaacttcttattgaaacctcaaaattatgataattctgaagaggaggaaagagtcatatcttcagtaatttcagtctcaatgagctcaaacccacccacattatatgaacttgaaaaaataacatttacattaagtcatcgaaaggtcacagataggtataggagtctatgtgcattttggaattactcacctgataccatgaatggcagctggtcttcagagggctgtgagctgacatactcaaatgagacccacacctcatgccgctgtaatcacctgacacattttgcaattttgatgtcctctggtccttccattggtattaaagattataatattcttacaaggatcactcaactaggaataattatttcactgatttgtcttgccatatgcatttttaccttctggttcttcagtgaaattcaaagcaccaggacaacaattcacaaaaatctttgctgtagcctatttcttgctgaacttgtttttcttgttgggatcaatacaaatactaataagctcttctgttcaatcattgccggactgctacactacttctttttagctgcttttgcatggatgtgcattgaaggcatacatctctatctcattgttgtgggtgtcatctacaacaagggatttttgcacaagaatttttatatctttggctatctaagcccagccgtggtagttggattttcggcagcactaggatacagatattatggcacaaccaaagtatgttggcttagcaccgaaaacaactttatttggagttttataggaccagcatgcctaatcattcttgttaatctcttggcttttggagtcatcatatacaaagtttttcgtcacactgcagggttgaaaccagaagttagttgctttgagaacataaggtcttgtgcaagaggagccctcgctcttctgttccttctcggcaccacctggatctttggggttctccatgttgtgcacgcatcagtggttacagcttacctcttcacagtcagcaatgctttccaggggatgttcatttttttattcctgtgtgttttatctagaaagattcaagaagaatattacagattgttcaaaaatgtcccctgttgttttggatgtttaaggtaaacatagagaatggtggataattacaactgcacaaaaataaaaattccaagctgtggatgaccaatgtataaaaatgactcatcaaattatccaattattaactactagacaaaaagtattttaaatcagtttttctgtttatgctataggaactgtagataataaggtaaaattatgtatcatatagatatactatgtttttctatgtgaaatagttctgtcaaaaatagtattgcagatatttggaaagtaattggtttctcaggagtgatatcactgcacccaaggaaagattttctttctaacacgagaagtatatgaatgtcctgaaggaaaccactggcttgatatttctgtgactcgtgttgcctttgaaactagtcccctaccacctcggtaatgagctccattacagaaagtggaacataagagaatgaaggggcagaatatcaaacagtgaaaagggaatgataagatgtattttgaatgaactgttttttctgtagactagctgagaaattgttgacataaaataaagaattgaagaaacacattttaccattttgtgaattgttctgaacttaaatgtccactaaaacaacttagacttctgtttgctaaatctgtttctttttctaatattctaaaaaaaaaaaaaaggtttacctccacaaattgaaaaaaaaaaaaaaaaaaaaaaaaaaaaaaaaaaaaaaaaaaaaaaaa

SEQ ID NO: 22 - protein, 690 aa, Homo sapiens [sequence omitted]

SEQ ID NO: 23 - DNA, 1686 bp, Homo sapiens
ctcctcttaacatacttgcagctaaaactaaatattgctgcttggggacctccttctagccttaaatttcagctcatcaccttcacctgccttggtcatggctctgctattctccttgatccttgccatttgcaccagacctggattcctagcgtctccatctggagtgcggctggtggggggcctccaccgctgtgaagggcgggtggaggtggaacagaaaggccagtggggcaccgtgtgtgatgacggctgggacattaaggacgtggctgtgttgtgccgggagctgggctgtggagctgccagcggaacccctagtggtattttgtatgagccaccagcagaaaaagagcaaaaggtcctcatccaatcagtcagttgcacaggaacagaagatacattggctcagtgtgagcaagaagaagtttatgattgttcacatgatgaagatgctggggcatcgtgtgagaacccagagagctctttctccccagtcccagagggtgtcaggctggctgacggccctgggcattgcaagggacgcgtggaagtgaagcaccagaaccagtggtataccgtgtgccagacaggctggagcctccgggccgcaaaggtggtgtgccggcagctgggatgtgggagggctgtactgactcaaaaacgctgcaacaagcatgcctatggccgaaaacccatctggctgagccagatgtcatgctcaggacgagaagcaacccttcaggattgcccttctgggccttgggggaagaacacctgcaaccatgatgaagacacgtgggtcgaatgtgaagatccctttgacttgagactagtaggaggagacaacctctgctctgggcgactggaggtgctgcacaagggcgtatggggctctgtctgtgatgacaactggggagaaaaggaggaccaggtggtatgcaagcaactgggctgtgggaagtccctctctccctccttcagagaccggaaatgctatggccctggggttggccgcatctggctggataatgttcgttgctcaggggaggagcagtccctggagcagtgccagcacagattttgggggtttcacgactgcacccaccaggaagatgtggctgtcatctgctcagtgtaggtgggcatcatctaatctgttgagtgcctgaatagaagaaaaacacagaagaagggagcatttactgtctacatgactgcatgggatgaacactgatcttcttctgcccttggactgggacttatacttggtgcccctgattctcaggccttcagagttggatcagaacttacaacatcaggtctagttctcaggccatcagacatagtttggaactacatcaccacctttcctatgtctccacattgcacacagcagattcccagcctccataattgtgtgtatcaactacttaaatacattctcacacacacacacacacacacacacacacacacacacacatacaccatttgtcctgtttctctgaagaactctgacaaaatacagattttggtactgaaagagattctagaggaacggaattttaaggataaattttctgaattggttatggggtttctgaaattggctctataatctaattagatataaaattctggtaactttatttacaataataaagatagcactatgtgttcaaa

SEQ ID NO: 24 - protein, 347 aa, Homo sapiens
MALLFSLILAICTRPGFLASPSGVRLVGGLHRCEGRVEVEQKGQWGTVCDDGWDIKDVAVLCRELGCGAASGTPSGILYEPPAEKEQKVLIQSVSCTGTEDTLAQCEQEEVYDCSHDEDAGASCENPESSFSPVPEGVRLADGPGHCKGRVEVKHQNQWYTVCQTGWSLRAAKVVCRQLGCGRAVLTQKRCNKHAYGRKPIWLSQMSCSGREATLQDCPSGPWGKNTCNHDEDTWVECEDPFDLRLVGGDNLCSGRLEVLHKGVWGSVCDDNWGEKEDQVVCKQLGCGKSLSPSFRDRKCYGPGVGRIWLDNVRCSGEEQSLEQCQHRFWGFHDCTHQEDVAVICSV

SEQ ID NO: 25 - DNA, 2197 bp, Homo sapiens
cggacgcgtgggcgtccggcggtcgcagagccaggaggcggaggcgcgcgggccagcctgggccccagcccacaccttcaccagggcccaggagccaccatgtggcgatgtccactggggctactgctgttgctgccgctggctggccacttggctctgggtgcccagcagggtcgtgggcgccgggagctagcaccgggtctgcacctgcggggcatccgggacgcgggaggccggtactgccaggagcaggacctgtgctgccgcggccgtgccgacgactgtgccctgccctacctgggcgccatctgttactgtgacctcttctgcaaccgcacggtctccgactgctgccctgacttctgggacttctgcctcggcgtgccacccccttttcccccgatccaaggatgtatgcatggaggtcgtatctatccagtcttgggaacgtactgggacaactgtaaccgttgcacctgccaggagaacaggcagtggcatggtggatccagacatgatcaaagccatcaaccagggcaactatggctggcaggctgggaaccacagcgccttctggggcatgaccctggatgagggcattcgctaccgcctgggcaccatccgcccatcttcctcggtcatgaacatgcatgaaatttatacagtgctgaacccaggggaggtgcttcccacagccttcgaggcctctgagaagtggcccaacctgattcatgagcctcttgaccaaggcaactgtgcaggctcctgggccttctccacagcagctgtggcatccgatcgtgtctcaatccattctctgggacacatgacgcctgtcctgtcgccccagaacctgctgtcttgtgacacccaccagcagcagggctgccgcggtgggcgtctcgatggtgcctggtggttcctgcgtcgccgaggggtggtgtctgaccactgctaccccttctcgggccgtgaacgagacgaggctggccctgcgcccccctgtatgatgcacagccgagccatgggtcggggcaagcgccaggccactgcccactgccccaacagctatgttaataacaatgacatctaccaggtcactcctgtctaccgcctcggctccaacgacaaggagatcatgaaggagctgatggagaatggccctgtccaagccctcatggaggtgcatgaggacttcttcctatacaagggaggcatctacagccacacgccagtgagccttgggaggccagagagataccgccggcatgggacccactcagtcaagatcacaggatggggagaggagacgctgccagatggaaggacgctcaaatactggactgcggccaactcctggggcccagcctggggcgagaggggccacttccgcatcgtgcgcggcgtcaatgagtgcgacatcgagagcttcgtgctgggcgtctggggccgcgtgggcatggaggacatgggtcatcactgaggctgcgggcaccacgcggggtccggcctgggatccaggctaagggccggcggaagaggccccaatggggcggtgaccccagcctcgcccgacagagcccggggcgcaggcgggcgccagggcgctaatcccggcgcgggttccgctgacgcagcgccccgcctgggagccgcgggcaggcgagactggcggagcccccagacctcccagtggggacggggcagggcctggcctgggaagagcacagctgcagatcccaggcctctggcgcccccactcaagactaccaaagccaggacacctcaagtctccagccccaataccccaccccaatcccgtattcttttttttttttttttagacagggtcttgctccgttgcccaggttggagtgcagtggcccatcagggctcactgtaacctccgactcctgggttcaagtgaccctcccacctcagcctctcaagtagctgggactacaggtgcaccaccacacctggctaatttttgtattttttgtaaagaggggggtctcactgtgttgcccaggctggtttcgaactcctgggctcaagcggtccacctgcctccgcctcccaaagtgctgggattgcaggcatgagccactgcacccagccctgtattcttattcttcagatatttatttttcttttcactgttttaaaataaaaccaaagtattgataaaaaaaaa

SEQ ID NO: 26 - protein, 164 aa, Homo sapiens
MWRCPLGLLLLLPLAGHLALGAQQGRGRRELAPGLHLRGIRDAGGRYCQEQDLCCRGRADDCALPYLGAICYCDLFCNRTVSDCCPDFWDFCLGVPPPFPPIQGCMHGGRIYPVLGTYWDNCNRCTCQENRQWHGGSRHDQSHQPGQLWLAGWEPQRLLGHDPG

SEQ ID NO: 27 - DNA, 2005 bp, Homo sapiens
cccacgcgtccggcaggtttttcttcaagccaagaaggacacggattggctgaaggagaaagtgcagagcttgcagacactggctgccaacaactctgcgttggccaaagccaacaacgacaccctggaggatatgaacagccagctcaactcattcacaggtcagatggagaacatcaccactatctctcaagccaacgagcagaacctgaaagacctgcaggacttacacaaagatgcagagaatagaacagccatcaagttcaaccaactggaggaacgcttccagctctttgagacggatattgtgaacatcattagcaatatcagttacacagcccaccacctgcggacgctgaccagcaatctaaatgaagtcaggaccacttgcacagataccttaccaaacacacagatgatctgacctccttgaataataccctggccaacatccgtttggattctgtttctctcaggatgcaacaagatttgatgaggtcgaggttagacactgaagtagccaacttatcagtgattatggaagaaatgaagctagtagactccaagcatggtcagctcatcaagaattttacaatactacaaggtccaccgggccccaggggtccaagaggtgacagaggatcccagggaccccctggcccaactggcaacaagggacagaaaggagagaagggggagcctggaccacctggccctgcgggtgagagaggcccaattggaccagctggtccccccggagagcgtggcggcaaaggatctaaaggctcccagggccccaaaggctcccgtggttcccctgggaagcccggccctcagggccccagtggggacccaggccccccgggcccaccaggcaaagagggactccccggccctcagggccctcctggcttccagggacttcagggcaccgttggggagcctggggtgcctggacctcggggactgccaggcttgcctggggtaccaggcatgccaggccccaagggcccccccggccctcctggcccatcaggagcggtggtgcccctggccctgcagaatgagccaaccccggcaccggaggacaatagctgcccgcctcactggaagaacttcacagacaaatgctactatttttcagttgagaaagaaatttttgaggatgcaaagcttttctgtgaagacaagtcttcacatcttgttttcataaacactagagaggaacagcaatggataaaaaaacagatggtagggagagagagccactggatcggcctcacagactcagagcgtgaaaatgaatggaagtggctggatgggacatctccagactacaaaaattggaaagctggacagccggataactggggtcatggccatgggccaggagaagactgtgctgggttgatttatgctgggcagtggaacgatttccaatgtgaagacgtcaataacttcatttgcgaaaaagacagggagacagtactgtcatctgcattataacggactgtgatgggatcacatgagcaaattttcagctctcaaaggcaaaggacactcctttctaattgcatcaccttctcatcagattgaaaaaaaaaaagcactgaaaaccaattactgaaaaaaaattgacagctagtgttttttaccatccgtcattacccaaagacttgggaactaaaatgttccccagggtgatatgctgattttcattgtgcacatggactgaatcacatagattctcctccgtcagtaaccgtgcgattatacaaattatgtcttccaaagtatggaacactccaatcagaaaaaggttatcattggtcgttgagttatgggaagaacttaagcatatactgtgtaaacagtgccatacatttctaaaatcccaagtgtaggaaaaatatgcagacatacagatatataggccaactattagtaataatatgaaatatacttaaagagcttttaaaactttgtatttttgtacaaaaaaaaa

SEQ ID NO: 28 - protein, 342 aa, Homo sapiens
MQQDLMRSRLDTEVANLSVIMEEMKLVDSKHGQLIKNFTILQGPPGPRGPRGDRGSQGPPGPTGNKGQKGEKGEPGPPGPAGERGPIGPAGPPGERGGKGSKGSQGPKGSRGSPGKPGPQGPSGDPGPPGPPGKEGLPGPQGPPGFQGLQGTVGEPGVPGPRGLPGLPGVPGMPGPKGPPGPPGPSGAVVPLALQNEPTPAPEDNSCPPHWKNFTDKCYYFSVEKEIFEDAKLFCEDKSSHLVFINTREEQQWIKKQMVGRESHWIGLTDSERENEWKWLDGTSPDYKNWKAGQPDNWGHGHGPGEDCAGLIYAGQWNDFQCEDVNNFICEKDRETVLSSAL

SEQ ID NO: 29 - DNA, 2454 bp, Homo sapiens
ggactaatctgtgggagcagtttattccagtatcacccagggtgcagccacaccaggactgtgttgaagggtgttttttttcttttaaatgtaatacctcctcatcttttcttcttacacagtgtctgagaacatttacattatagataagtagtacatggtggataacttctacttttaggaggactactctcttctgacagtcctagactggtcttctacactaagacaccatgaaggagtatgtgctcctattattcctggctttgtgctctgccaaacccttctttagcccttcacacatcgcactgaagaatatgatgctgaaggatatggaagacacagatgatgatgatgatgatgatgatgatgatgatgatgatgaggacaactctctttttccaacaagagagccaagaagccatttttttccatttgatctgtttccaatgtgtccatttggatgtcagtgctattcacgagttgtacattgctcagatttaggtttgacctcagtcccaaccaacattccatttgatactcgaatgcttgatcttcaaaacaataaaattaaggaaatcaaagaaaatgattttaaaggactcacttcactttatggtctgatcctgaacaacaacaagctaacgaagattcacccaaaagcctttctaaccacaaagaagttgcgaaggctgtatctgtcccacaatcaactaagtgaaataccacttaatcttcccaaatcattagcagaactcagaattcatgaaaataaagttaagaaaatacaaaaggacacattcaaaggaatgaatgctttacacgttttggaaatgagtgcaaaccctcttgataataatgggatagagccaggggcatttgaaggggtgacggtgttccatatcagaattgcagaagcaaaactgacctcagttcctaaaggcttaccaccaactttattggagcttcacttagattataataaaatttcaacagtggaacttgaggattttaaacgatacaaagaactacaaaggctgggcctaggaaacaacaaaatcacagatatcgaaaatgggagtcttgctaacataccacgtgtgagagaaatacatttggaaaacaataaactaaaaaaaatcccttcaggattaccagagttgaaatacctccagataatcttccttcattctaattcaattgcaagagtgggagtaaatgacttctgtccaacagtgccaaagatgaagaaatctttatacagtgcaataagtttattcaacaacccggtgaaatactgggaaatgcaacctgcaacatttcgttgtgttttgagcagaatgagtgttcagcttgggaactttggaatgtaataattagtaattggtaatgtccatttaatataagattcaaaaatccctacatttggaatacttgaactctattaataatggtagtattatatatacaagcaaatatctattctcaagtggtaagtccactgacttattttatgacaagaaatttcaacggaattttgccaaactattgatacataaggggttgagagaaacaagcatctattgcagtttcctttttgcgtacaaatgatcttacataaatctcatgcttgaccattcctttcttcataacaaaaaagtaagatattcggtatttaacactttgttatcaagcacattttaaaaagaactgtactgtaaatggaatgcttgacttagcaaaatttgtgctctttcatttgctgttagaaaaacagaattaacaaagacagtaatgtgaagagtgcattacactattcttattctttagtaacttgggtagtactgtaatatttttaatcatcttaaagtatgatttgatataatcttattgaaattaccttatcatgtcttagagcccgtctttatgtttaaaactaatttcttaaaataaagccttcagtaaatgttcattaccaacttgataaatgctactcataagagctggtttggggctatagcatatgcttttttttttttaattattacctgatttaaaaatctctgtaaaaacgtgtagtgtttcataaaatctgtaactcgcattttaatgatccgctattataagcttttaatagcatgaaaattgttaggctatataacattgccacttcaactctaaggaatatttttgagatatccctttggaagaccttgcttggaagagcctggacactaacaattctacaccaaattgtctcttcaaatacgtatggactggataactctgagaaacacatctagtataactgaataagcagagcatcaaattaaacagacagaaaccgaaagctctatataaatgctcagagttctttatgtatttcttattggcattcaacatatgtaaaatcagaaaacagggaaattttcattaaaaatattggtttgaaat

SEQ ID NO: 30 - protein, 379 aa, Homo sapiens
MKEYVLLLFLALCSAKPFFSPSHIALKNMMLKDMEDTDDDDDDDDDDDDDEDNSLFPTREPRSHFFPFDLFPMCPFGCQCYSRVVHCSDLGLTSVPTNIPFDTRMLDLQNNKIKEIKENDFKGLTSLYGLILNNNKLTKIHPKAFLTTKKLRRLYLSHNQLSEIPLNLPKSLAELRIHENKVKKIQKDTFKGMNALHVLEMSANPLDNNGIEPGAFEGVTVFHIRIAEAKLTSVPKGLPPTLLELHLDYNKISTVELEDFKRYKELQRLGLGNNKITDIENGSLANIPRVREIHLENNKLKKIPSGLPELKYLQIIFLHSNSIARVGVNDFCPTVPKMKKSLYSAISLFNNPVKYWEMQPATFRCVLSRMSVQLGNFGM

SEQ ID NO: 31 - DNA, 2372 bp, Homo sapiens
agcagggaaatccggatgtctcggttatgaagtggagcagtgagtgtgagcctcaacatagttccagaactctccatccggactagttattgagcatctgcctctcatatcaccagtggccatctgaggtgtttccctggctctgaaggggtaggcacgatggccaggtgcttcagcctggtgttgcttctcacttccatctggaccacgaggctcctggtccaaggctctttgcgtgcagaagagctttccatccaggtgtcatgcagaattatggggatcacccttgtgagcaaaaaggcgaaccagcagctgaatttcacagaagctaaggaggcctgtaggctgctgggactaagtttggccggcaaggaccaagttgaaacagccttgaaagctagctttgaaacttgcagctatggctgggttggagatggattcgtggtcatctctaggattagcccaaaccccaagtgtgggaaaaatggggtgggtgtcctgatttggaaggttccagtgagccgacagtttgcagcctattgttacaactcatctgatacttggactaactcgtgcattccagaaattatcaccaccaaagatcccatattcaacactcaaactgcaacacaaacaacagaatttattgtcagtgacagtacctactcggtggcatccccttactctacaatacctgcccctactactactcctcctgctccagcttccacttctattccacggagaaaaaaattgatttgtgtcacagaagtttttatggaaactagcaccatgtctacagaaactgaaccatttgttgaaaataaagcagcattcaagaatgaagctgctgggtttggaggtgtccccacggctctgctagtgcttgctctcctcttctttggtgctgcagctggtcttggattttgctatgtcaaaaggtatgtgaaggccttcccttttacaaacaagaatcagcagaaggaaatgatcgaaaccaaagtagtaaaggaggagaaggccaatgatagcaaccctaatgaggaatcaaagaaaactgataaaaacccagaagagtccaagagtccaagcaaaactaccgtgcgatgcctggaagctgaagtttagatgagacagaaatgaggagacacacctgaggctggtttctttcatgctccttaccctgccccagctggggaaatcaaaagggccaaagaaccaaagaagaaagtccacccttggttcctaactggaatcagctcaggactgccattggactatggagtgcaccaaagagaatgcccttctccttattgtaaccctgtctggatcctatcctcctacctccaaagcttcccacggcctttctagcctggctatgtcctaataatatcccactgggagaaaggagttttgcaaagtgcaaggacctaaaacatctcatcagtatccagtggtaaaaaggcctcctggctgtctgaggctaggtgggttgaaagccaaggagtcactgagaccaaggctttctctactgattccgcagctcagaccctttcttcagctctgaaagagaaacacgtatcccacctgacatgtccttctgagcccggtaagagcaaaagaatggcagaaaagtttagcccctgaaagccatggagattctcataacttgagacctaatctctgtaaagctaaaataaagaaatagaacaaggctgaggatacgacagtacactgtcagcagggactgtaaacacagacagggtcaaagtgttttctctgaacacattgagttggaatcactgtttagaacacacacacttactttttctggtctctaccactgctgatattttctctaggaaatatacttttacaagtaacaaaaataaaaactcttataaatttctatttttatctgagttacagaaatgattactaaggaagattactcagtaatttgtttaaaaagtaataaaattcaacaaacatttgctgaatagctactatatgtcaagtgctgtgcaaggtattacactctgtaattgaatattattcctcaaaaaattgcacatagtagaacgctatctgggaagctatttttttcagttttgatatttctagcttatctacttccaaactaatttttatttttgctgagactaatcttattcattttctctaatatggcaaccattataaccttaatttattattaacatacctaagaagtacattgttacctctatataccaaagcacattttaaaagtgccattaacaaatgtatcactagccctcctttttccaacaagaagggactgagagatgcagaaatatttgtgacaaaaaattaaagcatttagaaaactt

SEQ ID NO: 32 - protein, 322 aa, Homo sapiens
MARCFSLVLLLTSIWTTRLLVQGSLRAEELSIQVSCRIMGITLVSKKANQQLNFTEAKEACRLLGLSLAGKDQVETALKASFETCSYGWVGDGFVVISRISPNPKCGKNGVGVLIWKVPVSRQFAAYCYNSSDTWTNSCIPEIITTKDPIFNTQTATQTTEFIVSDSTYSVASPYSTIPAPTTTPPAPASTSIPRRKKLICVTEVFMETSTMSTETEPFVENKAAFKNEAAGFGGVPTALLVLALLFFGAAAGLGFCYVKRYVKAFPFTNKNQQKEMIETKVVKEEKANDSNPNEESKKTDKNPEESKSPSKTTVRCLEAEV

SEQ ID NO: 33 - DNA, 3367 bp, Homo sapiens
gaaaaaaaaaaaaagggaagcaagcttagctgtacaccctgagtcttgcaaaagctgcagccccacccaggagcagggtggtggctggggcgatggtggacgccctgaagatgtcccatggctactgaaggggctgcccagttagggaacagagtggcgggcatggtgtgtagcctatgggtgctgctcctggtgtcttcagttctggctctggaagaggtattgctggacaccaccggagagacatctgagattggctggctcacctacccaccaggggggtgggacgaggtgagtgttctggacgaccagcgacgcctgactcggacctttgaggcatgtcatgtggcaggggcccctccaggcaccgggcaggacaattggttgcagacacactttgtggagcggcgcggggcccagagggcgcacattcgactccacttctctgtgcgggcatgctccagcctgggtgtgagcggcggcacctgccgggagaccttcaccctttactaccgtcaggctgaggagcccgacagccctgacagcgtttcctcctggcacctcaaacgttggaccaaggtggacacaattgcagcagacgagagctttccatcctcctcctcctcctcctcctcctcttcttcctctgcagcgtgggctgtgggaccccacggggctgggcagcgggctggactgcaactgaacgtcaaagagcggagctttgggcctctcacccaacgcggcttctacgtggccttccaggacacgggggcctgcctggccctggtcgctgtcaggctcttctcctacacctgccctgccgtgctccgatcctttgcttcctttccagagacgcaggccagtggggctgggggggcctccctggtggcagctgtgggcacctgtgtggctcatgcagagccagaggaggatggagtagggggccaggcaggaggcagcccccccaggctgcactgcaacggggagggcaagtggatggtagctgtcgggggctgccgctgccagcctggataccaaccagcacgaggagacaaggcctgccaagcctgcccacgggggctctataaggcttctgctgggaatgctccctgctcaccatgccctgcccgcagtcacgctcccaacccagcagcccccgtttgcccctgcctggagggcttctaccgggccagttccgacccaccagaggccccctgcactggtcctccatcggctccccaggagctttggtttgaggtgcaaggctcagcactcatgctacactggcgcctgcctcgggagctggggggtcgaggggacctgctcttcaatgtcgtgtgcaaggagtgtgaaggccgccaggaacctgccagcggtggtgggggcacttgtcaccgctgcagggatgaggtccacttcgaccctcgccagagaggcctgactgagagccgagtgttagtggggggactccgggcacacgtaccctacatcttagaggtgcaggctgttaatggggtgtctgagctcagccctgaccctcctcaggctgcagccatcaatgtcagcaccagccatgaagtgccctctgctgtccctgtggtgcaccaggtgagccgggcatccaacagcatcacggtgtcctggccgcagcccgaccagaccaatgggaacatcctggactatcagctccgctactatgaccaggcagaagacgaatcccactccttcaccctgaccagcgagaccaacactgccaccgtgacacagctgagccctggccacatctatggtttccaggtgcgggcccggactgctgccggccacggcccctacgggggcaaagtctatttccagacacttcctcaaggggagctgtcttcccagcttccggaaagactctccttggtgatcggctccaccctgggggctttggccttcctcctgctggcagccatcaccgtgctggcggtcgtcttccagcggaagcggcgtgggactggctacacggagcagctgcagcaatacagcagcccaggactcggggtgaagtattacatcgacccctccacctacgaggacccctgtcaggccatccgagaacttgcccgggaagtcgatcctgcttatatcaagattgaggaggtcattgggacaggctcttttggagaagtgcgccagggccgcctgcagccacggggacggagggagcagactgtggccatccaggccctgtgggccgggggcgccgaaagcctgcagatgaccttcctgggccgggccgcagtgctgggtcagttccagcaccccaacatcctgcggctggagggcgtggtcaccaagagccgacccctcatggtgctgacggagttcatggagcttggccccctggacagcttcctcaggcagcgggagggccagttcagcagcctgcagctggtggccatgcagcggggagtggctgctgccatgcagtacctgtccagctttgccttcgtccatcgctcgctgtctgcccacagcgtgctggtgaatagccacttggtgtgcaaggtggcccgtcttggccacagtcctcagggcccaagttgtttgcttcgctgggcagccccagaggtcattgcacatggaaagcatactcatgtgggaagtgatgagttatggagaacggccttactgggacatgagtgagcaggaggtactaaatgcaatagagcaggagttccggctgcccccgcctccaggctgtcctcctggattacatctacttatgttggacacttggcagaaggaccgtgcccggcggcctcattttgaccagctggtggctgcatttgacaagatgatccgcaagccagataccctgcaggctggcggggacccaggggaaaggccttcccaggcccttctgacccctgtggccctggactttccttgtctggactcaccccaggcctggctttcagccattggactggagtgctaccaggacaacttctccaagtttggcctctgtaccttcagtgatgtggctcagctcagcctagaagacctgcctgccctgggcatcaccctggctggccaccagaagaagctgctgcaccacatccagctccttcagcaacacctgaggcagcagggctcagtggaggtctgagaatgacgatacccgtgactcagccctggacactggtccgagaagggacatgtgggacgtgagccgggctccaacagcctctgtgagagatgccccacaccaaacccaaccctccgatggctgcattccctggtcctccgcttttccaccagccccctcctcattaaagggaaagaagggaatttgcaaaaaaaaaaaaaaaaaaaaaaaaaa

SEQ ID NO: 34 - protein, 856 aa, Homo sapiens
MATEGAAQLGNRVAGMVCSLWVLLLVSSVLALEEVLLDTTGETSEIGWLTYPPGGWDEVSVLDDQRRLTRTFEACHVAGAPPGTGQDNWLQTHFVERRGAQRAHIRLHFSVRACSSLGVSGGTCRETFTLYYRQAEEPDSPDSVSSWHLKRWTKVDTIAADESFPSSSSSSSSSSSSAAWAVGPHGAGQRAGLQLNVKERSFGPLTQRGFYVAFQDTGACLALVAVRLFSYTCPAVLRSFASFPETQASGAGGASLVAAVGTCVAHAEPEEDGVGGQAGGSPPRLHCNGEGKWMVAVGGCRCQPGYQPARGDKACQACPRGLYKASAGNAPCSPCPARSHAPNPAAPVCPCLEGFYRASSDPPEAPCTGPPSAPQELWFEVQGSALMLHWRLPRELGGRGDLLFNVVCKECEGRQEPASGGGGTCHRCRDEVHFDPRQRGLTESRVLVGGLRAHVPYILEVQAVNGVSELSPDPPQAAAINVSTSHEVPSAVPVVHQVSRASNSITVSWPQPDQTNGNILDYQLRYYDQAEDESHSFTLTSETNTATVTQLSPGHIYGFQVRARTAAGHGPYGGKVYFQTLPQGELSSQLPERLSLVIGSTLGALAFLLLAAITVLAVVFQRKRRGTGYTEQLQQYSSPGLGVKYYIDPSTYEDPCQAIRELAREVDPAYIKIEEVIGTGSFGEVRQGRLQPRGRREQTVAIQALWAGGAESLQMTFLGRAAVLGQFQHPNILRLEGVVTKSRPLMVLTEFMELGPLDSFLRQREGQFSSLQLVAMQRGVAAAMQYLSSFAFVHRSLSAHSVLVNSHLVCKVARLGHSPQGPSCLLRWAAPEVIAHGKHTHVGSDELWRTALLGHE

SEQ ID NO: 35 - DNA, 1514 bp, Homo sapiens
ggggtctccctcagggccgggaggcacagcggtccctgcttgctgaagggctggatgtacgcatccgcaggttcccgcggacttgggggcgcccgctgagccccggcgcccgcagaagacttgtgtttgcctcctgcagcctcaacccggagggcagcgagggcctaccaccatgatcactggtgtgttcagcatgcgcttgtggaccccagtgggcgtcctgacctcgctggcgtactgcctgcaccagcggcgggtggccctggccgagctgcaggaggccgatggccagtgtccggtcgaccgcagcctgctgaagttgaaaatggtgcaggtcgtgtttcgacacggggctcggagtcctctcaagccgctcccgctggaggagcaggtagagtggaacccccagctattagaggtcccaccccaaactcagtttgattacacagtcaccaatctagctggtggtccgaaaccatattctccttacgactctcaataccatgagaccaccctgaaggggggcatgtttgctgggcagctgaccaaggtgggcatgcagcaaatgtttgccttgggagagagactgaggaagaactatgtggaagacattccctttctttcaccaaccttcaacccacaggaggtctttattcgttccactaacatttttcggaatctggagtccacccgttgtttgctggctgggcttttccagtgtcagaaagaaggacccatcatcatccacactgatgaagcagattcagaagtcttgtatcccaactaccaaagctgctggagcctgaggcagagaaccagaggccggaggcagactgcctctttacagccaggaatctcagaggatttgaaaaaggtgaaggacaggatgggcattgacagtagtgataaagtggacttcttcatcctcctggacaacgtggctgccgagcaggcacacaacctcccaagctgccccatgctgaagagatttgcacggatgatcgaacagagagctgtggacacatccttgtacatactgcccaaggaagacagggaaagtcttcagatggcagtaggcccattcctccacatcctagagagcaacctgctgaaagccatggactctgccactgcccccgacaagatcagaaagctgtatctctatgcggctcatgatgtgaccttcataccgctcttaatgaccctggggatttttgaccacaaatggccaccgtttgctgttgacctgaccatggaactttaccagcacctggaatctaaggagtggtttgtgcagctctattaccacgggaaggagcaggtgccgagaggttgccctgatgggctctgcccgctggacatgttcttgaatgccatgtcagtttataccttaagcccagaaaaataccatgcactctgctctcaaactcaggtgatggaagttggaaatgaagagtaactgatttataaaagcaggatgtgttgattttaaaataaagtgcctttatacaatg

SEQ ID NO: 36 - protein, 428 aa, Homo sapiens
MITGVFSMRLWTPVGVLTSLAYCLHQRRVALAELQEADGQCPVDRSLLKLKMVQVVFRHGARSPLKPLPLEEQVEWNPQLLEVPPQTQFDYTVTNLAGGPKPYSPYDSQYHETTLKGGMFAGQLTKVGMQQMFALGERLRKNYVEDIPFLSPTFNPQEVFIRSTNIFRNLESTRCLLAGLFQCQKEGPIIIHTDEADSEVLYPNYQSCWSLRQRTRGRRQTASLQPGISEDLKKVKDRMGIDSSDKVDFFILLDNVAAEQAHNLPSCPMLKRFARMIEQRAVDTSLYILPKEDRESLQMAVGPFLHILESNLLKAMDSATAPDKIRKLYLYAAHDVTFIPLLMTLGIFDHKWPPFAVDLTMELYQHLESKEWFVQLYYHGKEQVPRGCPDGLCPLDMFLNAMSVYTLSPEKYHALCSQTQVMEVGNEE

SEQ ID NO: 37 - DNA, 1427 bp, Homo sapiens
actgcactcggttctatcgattgaattccccggggatcctctagagatccctcgacctcgacccacgcgtccgcggacgcgtgggcggacgcgtgggccggctaccaggaagagtctgccgaaggtgaaggccatggacttcatcacctccacagccatcctgcccctgctgttcggctgcctgggcgtcttcggcctcttccggctgctgcagtgggtgcgcgggaaggcctacctgcggaatgctgtggtggtgatcacaggcgccacctcagggctgggcaaagaatgtgcaaaagtcttctatgctgcgggtgctaaactggtgctctgtggccggaatggtggggccctagaagagctcatcagagaacttaccgcttctcatgccaccaaggtgcagacacacaagccttacttggtgaccttcgacctcacagactctggggccatagttgcagcagcagctgagatcctgcagtgctttggctatgtcgacatacttgtcaacaatgctgggatcagctaccgtggtaccatcatggacaccacagtggatgtggacaagagggtcatggagacaaactactttggcccagttgctctaacgaaagcactcctgccctccatgatcaagaggaggcaaggccacattgtcgccatcagcagcatccagggcaagatgagcattccttttcgatcagcatatgcagcctccaagcacgcaacccaggctttctttgactgtctgcgtgccgagatggaacagtatgaaattgaggtgaccgtcatcagccccggctacatccacaccaacctctctgtaaatgccatcaccgcggatggatctaggtatggagttatggacaccaccacagcccagggccgaagccctgtggaggtggcccaggatgttcttgctgctgtggggaagaagaagaaagatgtgatcctggctgacttactgccttccttggctgtttatcttcgaactctggctcctgggctcttcttcagcctcatggcctccagggccagaaaagagcggaaatccaagaactcctagtactctgaccagccagggccagggcagagaagcagcactcttaggcttgcttactctacaagggacagttgcatttgttgagactttaatggagatttgtctcacaagtgggaaagactgaagaaacacatctcgtgcagatctgctggcagaggacaatcaaaaacgacaacaagcttcttcccagggtgaggggaaacacttaaggaataaatatggagctggggtttaacactaaaaactagaaataaacatctcaaacagtaaaaaaaaaaaaaaagggcggccgcgactctagagtcgacctgcagaagcttggccgccatggcccaacttgtttattgcagcttataatggttac

SEQ ID NO: 38 - protein, 310 aa, Homo sapiens
MDFITSTAILPLLFGCLGVFGLFRLLQWVRGKAYLRNAVVVITGATSGLGKECAKVFYAAGAKLVLCGRNGGALEELIRELTASHATKVQTHKPYLVTFDLTDSGAIVAAAAEILQCFGYVDILVNNAGISYRGTIMDTTVDVDKRVMETNYFGPVALTKALLPSMIKRRQGHIVAISSIQGKMSIPFRSAYAASKHATQAFFDCLRAEMEQYEIEVTVISPGYIHTNLSVNAITADGSRYGVMDTTTAQGRSPVEVAQDVLAAVGKKKKDVILADLLPSLAVYLRTLAPGLFFSLMASRARKERKSKNS

SEQ ID NO: 39 - DNA, 3401 bp, Homo sapiens
gcaagccaaggcgctgtttgagaaggtgaagaagttccggacccatgtggaggagggggacattgtgtaccgcctctacatgcggcagaccatcatcaaggtgatcaagttcatcctcatcatctgctacaccgtctactacgtgcacaacatcaagttcgacgtggactgcaccgtggacattgagagcctgacgggctaccgcacctaccgctgtgcccaccccctggccacactcttcaagatcctggcgtccttctacatcagcctagtcatcttctacggcctcatctgcatgtacacactgtggtggatgctacggcgctccctcaagaagtactcgtttgagtcgatccgtgaggagagcagctacagcgacatccccgacgtcaagaacgacttcgccttcatgctgcacctcattgaccaatacgacccgctctactccaagcgcttcgccgtcttcctgtcggaggtgagtgagaacaagctgcggcagctgaacctcaacaacgagtggacgctggacaagctccggcagcggctcaccaagaacgcgcaggacaagctggagctgcacctgttcatgctcagtggcatccctgacactgtgtttgacctggtggagctggaggtcctcaagctggagctgatccccgacgtgaccatcccgcccagcattgcccagctcacgggcctcaaggagctgtggctctaccacacagcggccaagattgaagcgcctgcgctggccttcctgcgcgagaacctgcgggcgctgcacatcaagttcaccgacatcaaggagatcccgctgtggatctatagcctgaagacactggaggagctgcacctgacgggcaacctgagcgcggagaacaaccgctacatcgtcatcgacgggctgcgggagctcaaacgcctcaaggtgctgcggctcaagagcaacctaagcaagctgccacaggtggtcacagatgtgggcgtgcacctgcagaagctgtccatcaacaatgagggcaccaagctcatcgtcctcaacagcctcaagaagatggcgaacctgactgagctggagctgatccgctgcgacctggagcgcatcccccactccatcttcagcctccacaacctgcaggagattgacctcaaggacaacaacctcaagaccatcgaggagatcatcagcttccagcacctgcaccgcctcacctgccttaagctgtggtacaaccacatcgcctacatccccatccagatcggcaacctcaccaacctggagcgcctctacctgaaccgcaacaagatcgagaagatccccacccagctcttctactgccgcaagctgcgctacctggacctcagccacaacaacctgaccttcctccctgccgacatcggcctcctgcagaacctccagaacctagccatcacggccaaccggatcgagacgctccctccggagctcttccagtgccggaagctgcgggccctgcacctgggcaacaacgtgctgcagtcactgccctccagggtgggcgagctgaccaacctgacgcagatcgagctgcggggcaaccggctggagtgcctgcctgtggagctgggcgagtgcccactgctcaagcgcagcggcttggtggtggaggaggacctgttcaacacactgccacccgaggtgaaggagcggctgtggagggctgacaaggagcaggcctgagcgaggccggcccagcacagcaagcagcaggaccgctgcccagtcctcaggcccggaggggcaggcctagcttctcccagaactcccggacagccaggacagcctcgcggctgggcaggagcctggggccgcttgtgagtcaggccagagcgagaggacagtatctgtggggctggccccttttctccctctgagactcacgtcccccagggcaagtgcttgtggaggagagcaagtctcaagagcgcagtatttggataatcagggtctcctccctggaggccagctctgccccaggggctgagctgccaccagaggtcctgggaccctcactttagttcttggtatttatttttctccatctcccacctccttcatccagataacttatacattcccaagaaagttcagcccagatggaaggtgttcagggaaaggtgggctgccttttccccttgtccttatttagcgatgccgccgggcatttaacacccacctggacttcagcagagtggtccggggcgaaccagccatgggacggtcacccagcagtgccgggctgggctctgcggtgcggtccacgggagagcaggcctccagctggaaaggccaggcctggagcttgcctcttcagtttttgtggcagttttagttttttgttttttttttttttaatcaaaaaacaattttttttaaaaaaaagctttgaaaatggatggtttgggtattaaaaagaaaaaaaaaacttaaaaaaaaaaagacactaacggccagtgagttggagtctcagggcagggtggcagtttcccttgagcaaagcagccagacgttgaactgtgtttcctttccctgggcgcagggtgcagggtgtcttccggatctggtgtgaccttggtccaggagttctatttgttcctggggagggaggtttttttgtttgttttttgggtttttttggtgtcttgttttctttctcctccatgtgtcttggcaggcactcatttctgtggctgtcggccagagggaatgttctggagctgccaaggagggaggagactcgggttggctaatccccggatgaacggtgctccattcgcacctcccctcctcgtgcctgccctgcctctccacgcacagtgttaaggagccaagaggagccacttcgcccagactttgtttccccacctcctgcggcatgggtgtgtccagtgccaccgctggcctccgctgcttccatcagccctgtcgccacctggtccttcatgaagagcagacacttagaggctggtcgggaatggggaggtcgcccctgggagggcaggcgttggttccaagccggttcccgtccctggcgcctggagtgcacacagcccagtcggcacctggtggctggaagccaacctgctttagatcactcgggtccccaccttagaagggtccccgccttagatcaatcacgtggacactaaggcacgttttagagtctcttgtcttaatgattatgtccatccgtctgtccgtccatttgtgttttctgcgtcgtgtcattggatataatcctcagaaataatgcacactagcctctgacaaccatgaagcaaaaatccgttacatgtgggtctgaacttgtagactcggtcacagtatcaaataaaatctataacagaaaaaaaaaaaaaaa

SEQ ID NO: 40 - protein, 546 aa, Homo sapiens
MRQTIIKVIKFILIICYTVYYVHNIKFDVDCTVDIESLTGYRTYRCAHPLATLFKILASFYISLVIFYGLICMYTLWWMLRRSLKKYSFESIREESSYSDIPDVKNDFAFMLHLIDQYDPLYSKRFAVFLSEVSENKLRQLNLNNEWTLDKLRQRLTKNAQDKLELHLFMLSGIPDTVFDLVELEVLKLELIPDVTIPPSIAQLTGLKELWLYHTAAKIEAPALAFLRENLRALHIKFTDIKEIPLWIYSLKTLEELHLTGNLSAENNRYIVIDGLRELKRLKVLRLKSNLSKLPQVVTDVGVHLQKLSINNEGTKLIVLNSLKKMANLTELELIRCDLERIPHSIFSLHNLQEIDLKDNNLKTIEEIISFQHLHRLTCLKLWYNHIAYIPIQIGNLTNLERLYLNRNKIEKIPTQLFYCRKLRYLDLSHNNLTFLPADIGLLQNLQNLAITANRIETLPPELFQCRKLRALHLGNNVLQSLPSRVGELTNLTQIELRGNRLECLPVELGECPLLKRSGLVVEEDLFNTLPPEVKERLWRADKEQA

SEQ ID NO: 41 - DNA, 2482 bp, Homo sapiens
gggggagaaggcggccgagccccagctctccgagcaccgggtcggaagccgcgacccgagccgcgcaggaagctgggaccggaacctcggcggacccggccccacccaactcacctgcgcaggtcaccagcaccctcggaacccagaggcccgcgctctgaaggtgacccccctggggaggaaggcgatggcccctgcgaggacgatggcccgcgcccgcctcgccccggccggcatccctgccgtcgccttgtggcttctgtgcacgctcggcctccagggcacccaggccgggccaccgcccgcgccccctgggctgcccgcgggagccgactgcctgaacagctttaccgccggggtgcctggcttcgtgctggacaccaacgcctcggtcagcaacggagctaccttcctggagtcccccaccgtgcgccggggctgggactgcgtgcgcgcctgctgcaccacccagaactgcaacttggcgctagtggagctgcagcccgaccgcggggaggacgccatcgccgcctgcttcctcatcaactgcctctacgagcagaacttcgtgtgcaagttcgcgcccagggagggcttcatcaactacctcacgagggaagtgtaccgctcctaccgccagctgcggacccagggctttggagggtctgggatccccaaggcctgggcaggcatagacttgaaggtacaaccccaggaacccctggtgctgaaggatgtggaaaacacagattggcgcctactgcggggtgacacggatgtcagggtagagaggaaagacccaaaccaggtggaactgtggggactcaaggaaggcacctacctgttccagctgacagtgactagctcagaccacccagaggacacggccaacgtcacagtcactgtgctgtccaccaagcagacagaagactactgcctcgcatccaacaaggtgggtcgctgccggggctctttcccacgctggtactatgaccccacggagcagatctgcaagagtttcgtttatggaggctgcttgggcaacaagaacaactaccttcgggaagaagagtgcattctagcctgtcggggtgtgcaaggtgggcctttgagaggcagctctggggctcaggcgactttcccccagggcccctccatggaaaggcgccatccagtgtgctctggcacctgtcagcccacccagttccgctgcagcaatggctgctgcatcgacagtttcctggagtgtgacgacacccccaactgccccgacgcctccgacgaggctgcctgtgaaaaatacacgagtggctttgacgagctccagcgcatccatttccccagtgacaaagggcactgcgtggacctgccagacacaggactctgcaaggagagcatcccgcgctggtactacaaccccttcagcgaacactgcgcccgctttacctatggtggttgttatggcaacaagaacaactttgaggaagagcagcagtgcctcgagtcttgtcgcggcatctccaagaaggatgtgtttggcctgaggcgggaaatccccattcccagcacaggctctgtggagatggctgtcacagtgttcctggtcatctgcattgtggtggtggtagccatcttgggttactgcttcttcaagaaccagagaaaggacttccacggacaccaccaccacccaccacccacccctgccagctccactgtctccactaccgaggacacggagcacctggtctataaccacaccacccggcccctctgagcctgggtctcaccggctctcacctggccctgcttcctgcttgccaaggcagaggcctgggctgggaaaaactttggaaccagactcttgcctgtttcccaggcccactgtgcctcagagaccagggctccagcccctcttggagaagtctcagctaagctcacgtcctgagaaagctcaaaggtttggaaggagcagaaaacccttgggccagaagtaccagactagatggacctgcctgcataggagtttggaggaagttggagttttgtttcctctgttcaaagctgcctgtccctaccccatggtgctaggaagaggagtggggtggtgtcagaccctggaggccccaaccctgtcctcccgagctcctcttccatgctgtgcgcccagggctgggaggaaggacttccctgtgtagtttgtgctgtaaagagttgctttttgtttatttaatgctgtggcatgggtgaagaggaggggaagaggcctgtttggcctctctgtcctctcttcctcttcccccaagattgagctctctgcccttgatcagccccaccctggcctagaccagcagacagagccaggagaggctcagctgcattccgcagcccccacccccaaggttctccaacatcacagcccagcccacccactgggtaataaaagtggtttgtggaaaaaaaaaaaaaaaaaaaaaaaaaa

SEQ ID NO: 42 - protein, 529 aa, Homo sapiens [sequence omitted]

SEQ ID NO: 43 - DNA, 1685 bp, Homo sapiens
cccacgcgtccgcacctcggccccgggctccgaagcggctcgggggcgccctttcggtcaacatcgtagtccaccccctccccatccccagcccccggggattcaggctcgccagcgcccagccagggagccggccgggaagcgcgatgggggccccagccgcctcgctcctgctcctgctcctgctgttcgcctgctgctgggcgcccggcggggccaacctctcccaggacgacagccagccctggacatctgatgaaacagtggtggctggtggcaccgtggtgctcaagtgccaagtgaaagatcacgaggactcatccctgcaatggtctaaccctgctcagcagactctctactttggggagaagagagcccttcgagataatcgaattcagctggttacctctacgccccacgagctcagcatcagcatcagcaatgtggccctggcagacgagggcgagtacacctgctcaatcttcactatgcctgtgcgaactgccaagtccctcgtcactgtgctaggaattccacagaagcccatcatcactggttataaatcttcattacgggaaaaagacacagccaccctaaactgtcagtcttctgggagcaagcctgcagcccggctcacctggagaaagggtgaccaagaactccacggagaaccaacccgcatacaggaagatcccaatggtaaaaccttcactgtcagcagctcggtgacattccaggttacccgggaggatgatggggcgagcatcgtgtgctctgtgaaccatgaatctctaaagggagctgacagatccacctctcaacgcattgaagttttatacacaccaactgcgatgattaggccagaccctccccatcctcgtgagggccagaagctgttgctacactgtgagggtcgcggcaatccagtcccccagcagtacctatgggagaaggagggcagtgtgccacccctgaagatgacccaggagagtgccctgatcttccctttcctcaacaagagtgacagtggcacctacggctgcacagccaccagcaacatgggcagctacaaggcctactacaccctcaatgttaatgaccccagtccggtgccctcctcctccagcacctaccacgccatcatcggtgggatcgtggctttcattgtcttcctgctgctcatcatgctcatcttccttggccactacttgatccggcacaaaggaacctacctgacacatgaggcaaaaggctccgacgatgctccagacgcggacacggccatcatcaatgcagaaggcgggcagtcaggaggggacgacaagaaggaatatttcatctagaggcgcctgcccacttcctgcgccccccaggggccctgtggggactgctggggccgtcaccaacccggacttgtacagagcaaccgcagggccgcccctcccgcttgctccccagcccacccacccccctgtacagaatgtctgctttgggtgcggttttgtactcggtttggaatggggagggaggagggcggggggaggggagggttgccctcagccctttccgtggcttctctgcatttgggttattattatttttgtaacaatcccaaatcaaatctgtctccaggctggagaggcaggagccctggggtgagaaaagcaaaaaacaaacaaaaaaca

SEQ ID NO: 44 - protein, 398 aa, Homo sapiens
MGAPAASLLLLLLLFACCWAPGGANLSQDDSQPWTSDETVVAGGTVVLKCQVKDHEDSSLQWSNPAQQTLYFGEKRALRDNRIQLVTSTPHELSISISNVALADEGEYTCSIFTMPVRTAKSLVTVLGIPQKPIITGYKSSLREKDTATLNCQSSGSKPAARLTWRKGDQELHGEPTRIQEDPNGKTFTVSSSVTFQVTREDDGASIVCSVNHESLKGADRSTSQRIEVLYTPTAMIRPDPPHPREGQKLLLHCEGRGNPVPQQYLWEKEGSVPPLKMTQESALIFPFLNKSDSGTYGCTATSNMGSYKAYYTLNVNDPSPVPSSSSTYHAIIGGIVAFIVFLLLIMLIFLGHYLIRHKGTYLTHEAKGSDDAPDADTAIINAEGGQSGGDDKKEYFI

SEQ ID NO: 45 - DNA, 2479 bp, Homo sapiens
acttgccatcacctgttgccagtgtggaaaaattctccctgttgaattttttgcacatggaggacagcagcaaagagggcaacacaggctgataagaccagagacagcagggagattattttaccatacgccctcaggacgttccctctagctggagttctggacttcaacagaaccccatccagtcattttgattttgctgtttattttttttttctttttctttttcccaccacattgtattttatttccgtacttcagaaatgggcctacagaccacaaagtggcccagccatggggcttttttcctgaagtcttggcttatcatttccctggggctctactcacaggtgtccaaactcctggcctgccctagtgtgtgccgctgcgacaggaactttgtctactgtaatgagcgaagcttgacctcagtgcctcttgggatcccggagggcgtaaccgtactctacctccacaacaaccaaattaataatgctggatttcctgcagaactgcacaatgtacagtcggtgcacacggtctacctgtatggcaaccaactggacgaattccccatgaaccttcccaagaatgtcagagttctccatttgcaggaaaacaatattcagaccatttcacgggctgctcttgcccagctcttgaagcttgaagagctgcacctggatgacaactccatatccacagtgggggtggaagacggggccttccgggaggctattagcctcaaattgttgtttttgtctaagaatcacctgagcagtgtgcctgttgggcttcctgtggacttgcaagagctgagagtggatgaaaatcgaattgctgtcatatccgacatggccttccagaatctcacgagcttggagcgtcttattgtggacgggaacctcctgaccaacaagggtatcgccgagggcaccttcagccatctcaccaagctcaaggaattttcaattgtacgtaattcgctgtcccaccctcctcccgatctcccaggtacgcatctgatcaggctctatttgcaggacaaccagataaaccacattcctttgacagccttctcaaatctgcgtaagctggaacggctggatatatccaacaaccaactgcggatgctgactcaaggggtttttgataatctctccaacctgaagcagctcactgctcggaataacccttggttttgtgactgcagtattaaatgggtcacagaatggctcaaatatatcccttcatctctcaacgtgcggggtttcatgtgccaaggtcctgaacaagtccgggggatggccgtcagggaattaaatatgaatcttttgtcctgtcccaccacgacccccggcctgcctctcttcaccccagccccaagtacagcttctccgaccactcagcctcccaccctctctattccaaaccctagcagaagctacacgcctccaactcctaccacatcgaaacttcccacgattcctgactgggatggcagagaaagagtgaccccacctatttctgaacggatccagctctctatccattttgtgaatgatacttccattcaagtcagctggctctctctcttcaccgtgatggcatacaaactcacatgggtgaaaatgggccacagtttagtagggggcatcgttcaggagcgcatagtcagcggtgagaagcaacacctgagcctggttaacttagagccccgatccacctatcggatttgtttagtgccactggatgcttttaactaccgcgcggtagaagacaccatttgttcagaggccaccacccatgcctcctatctgaacaacggcagcaacacagcgtccagccatgagcagacgacgtcccacagcatgggctccccctttctgctggcgggcttgatcgggggcgcggtgatatttgtgctggtggtcttgctcagcgtcttttgctggcatatgcacaaaaaggggcgctacacctcccagaagtggaaatacaaccggggccggcggaaagatgattattgcgaggcaggcaccaagaaggacaactccatcctggagatgacagaaaccagttttcagatcgtctccttaaataacgatcaactccttaaaggagatttcagactgcagcccatttacaccccaaatgggggcattaattacacagactgccatatccccaacaacatgcgatactgcaacagcagcgtgccagacctggagcactgccatacgtgacagccagaggcccagcgttatcaaggcggacaattagactcttgagaacacactcgtgtgtgcacataaagacacgcagattacatttgataaatgttacacagatgcatttgtgcatttgaatactctgtaatttatacggtgtactatataatgggatttaaaaaaagtgctatcttttctatttcaagttaattacaaacagttttgtaactctttgctttttaaatctt

SEQ ID NO: 46 - protein, 660 aa, Homo sapiens
MGLQTTKWPSHGAFFLKSWLIISLGLYSQVSKLLACPSVCRCDRNFVYCNERSLTSVPLGIPEGVTVLYLHNNQINNAGFPAELHNVQSVHTVYLYGNQLDEFPMNLPKNVRVLHLQENNIQTISRAALAQLLKLEELHLDDNSISTVGVEDGAFREAISLKLLFLSKNHLSSVPVGLPVDLQELRVDENRIAVISDMAFQNLTSLERLIVDGNLLTNKGIAEGTFSHLTKLKEFSIVRNSLSHPPPDLPGTHLIRLYLQDNQINHIPLTAFSNLRKLERLDISNNQLRMLTQGVFDNLSNLKQLTARNNPWFCDCSIKWVTEWLKYIPSSLNVRGFMCQGPEQVRGMAVRELNMNLLSCPTTTPGLPLFTPAPSTASPTTQPPTLSIPNPSRSYTPPTPTTSKLPTIPDWDGRERVTPPISERIQLSIHFVNDTSIQVSWLSLFTVMAYKLTWVKMGHSLVGGIVQERIVSGEKQHLSLVNLEPRSTYRICLVPLDAFNYRAVEDTICSEATTHASYLNNGSNTASSHEQTTSHSMGSPFLLAGLIGGAVIFVLVVLLSVFCWHMHKKGRYTSQKWKYNRGRRKDDYCEAGTKKDNSILEMTETSFQIVSLNNDQLLKGDFRLQPIYTPNGGINYTDCHIPNNMRYCNSSVPDLEHCHT

SEQ ID NO: 47 - DNA, 2573 bp, Murine
gcagcgagcgccgggtgcggccctgccgccgcagggatgtgaccttcaccgtcgcttagccaggatgaccggagcccgtgtctcgcggcgtccgcgcctcgcttcagcctcccgggtgctctgaccgcacgctcccggctgctaggctccccggcaccggcctcgccatgccgccaccgcccgggcccgccgccgccctgggcactgcgcttctgctgctcctgctggcttccgagtcttctcacactgtgctgttgcgggcgcgtgaggcggcgcagtttctgcggcccaggcagcgccgcgcctaccaagtcttcgaggaggccaagcagggccacctggaacgggagtgcgtggaggaggtgtgcagcaaagaggaggccagagaggtgttcgagaacgaccccgagacggagtatttctatccacgatatcaagagtgcatgagaaaatatggcaggcctgaagaaaaaaacccagatttcgccaaatgtgttcagaacttgcctgaccagtgcaccccaaacccttgtgataagaagggtactcatatctgccaagacctcatgggcaacttcttctgcgtgtgcacagatggctggggaggccggctctgtgacaaagatgtcaatgagtgtgtccagaagaatgggggctgcagccaggtctgccacaacaaaccaggaagcttccaatgtgcctgccatagtggcttctcgcttgcatcagacggccagacctgccaagatatcgatgaatgcacagactcagacacctgtggggacgcgcgatgcaagaacttgccaggctcctactcttgcctctgcgatgagggatatacatacagctccaaggagaagacctgccaagatgtggacgagtgccagcaggatcgctgtgagcagacctgtgtcaactccccaggcagctatacctgccactgtgatgggcgagggggcctaaaactatccccagacatggatacttgtgaggacatcttaccatgtgtgcccttcagcatggccaagagcgtgaagtccttgtacctgggccgcatgttcagcgggacccccgtgattagactacgcttcaagaggcttcagcctaccaggctgctggctgaatttgacttccgcacttttgaccctgaaggagtcctcttcttcgctggaggccgttcagacagcacctggattgtcctgggcctaagagctgggcggcttgagctgcagcttcggtacaatggcgttgggcgcatcaccagcagcgggccaaccatcaaccacggcatgtggcaaactatctccgtggaagagctggaacgtaaccttgtcatcaaggtcaacaaagatgctgtaatgaagatcgcggtagctggggagctgtttcagctggagaggggcctctatcacctgaatctcaccgtgggcggcattcccttcaaggagagtgagctcgtccagccgattaaccctcgcctggatgggtgcatgaggagttggaactggctgaacggggaagacagcgccatccaggagacagtcaaggcaaacacaaaaatgcagtgcttctctgtgacagaaaggggctccttcttcccggggaatggatttgctacctacaggctcaactacacccgaacatcgctggatgtcggcacggaaaccacctgggaagttaaagttgtggctcggatccgccctgccacggacacgggggtgctgctggcgctggtgggggacgacgatgtcgtcatctctgtggccctagtcgactaccactctacaaagaagctcaagaagcagttggtggtcctggcagttgaggatgttgccctggcactgatggaaatcaaggtgtgcgacagccaggaacacacggtcactgtctccctgcgggagggtgaggccaccctagaagtggatggcacaaagggccagagtgaagtgagcactgcccagctgcaggagcgactggacacacttaagacacatctgcaaggctctgtgcacacctatgttggaggcctgccagaagtatcggtgatttctgcacccgtcactgcgttctaccgcggatgcatgactctggaggtaaacgggaaaatcctggacctggatacggcctcgtacaagcacagtgacatcacctcccactcctgcccgcctgtggagcatgccaccccctagaccgagctgcaagagggctccacacctaaagacaaaaatgaagcagggtttggacacacagcactggctcctctcgcatggtcctgcaacactggagcagcgtggaccgcccttgtggtttttttttcttgagatctttctttttgccttgtaacatatctgtacataatggacgggtgtcgggtcaccggctgctcagagagagccacgtgacctggtgggagctggctggaaggggctgggctagaggggctggcagtttgcagcagaacggatgtgaagaaaataattctctattatttttattactacatgcttctttctgactctaaaatatggaaaataaaatatttacagaaacctttttaaaaaaaaaaaaaaaaa

SEQ ID NO: 48 - protein, 673 aa, Murine
MPPPPGPAAALGTALLLLLLASESSHTVLLRAREAAQFLRPRQRRAYQVFEEAKQGHLERECVEEVCSKEEAREVFENDPETEYFYPRYQECMRKYGRPEEKNPDFAKCVQNLPDQCTPNPCDKKGTHICQDLMGNFFCVCTDGWGGRLCDKDVNECVQKNGGCSQVCHNKPGSFQCACHSGFSLASDGQTCQDIDECTDSDTCGDARCKNLPGSYSCLCDEGYTYSSKEKTCQDVDECQQDRCEQTCVNSPGSYTCHCDGRGGLKLSPDMDTCEDILPCVPFSMAKSVKSLYLGRMFSGTPVIRLRFKRLQPTRLLAEFDFRTFDPEGVLFFAGGRSDSTWIVLGLRAGRLELQLRYNGVGRITSSGPTINHGMWQTISVEELERNLVIKVNKDAVMKIAVAGELFQLERGLYHLNLTVGGIPFKESELVQPINPRLDGCMRSWNWLNGEDSAIQETVKANTKMQCFSVTERGSFFPGNGFATYRLNYTRTSLDVGTETTWEVKVVARIRPATDTGVLLALVGDDDVVISVALVDYHSTKKLKKQLVVLAVEDVALALMEIKVCDSQEHTVTVSLREGEATLEVDGTKGQSEVSTAQLQERLDTLKTHLQGSVHTYVGGLPEVSVISAPVTAFYRGCMTLEVNGKILDLDTASYKHSDITSHSCPPVEHATP

SEQ ID NO: 49 - DNA, 2586 bp, Homo sapiens
cgccgcgctcccgcacccgcggcccgcccaccgcgccgctcccgcatctgcacccgcagcccggcggcctcccggcgggagcgagcagatccagtccggcccgcagcgcaactcggtccagtcggggcggcggctgcgggcgcagagcggagatgcagcggcttggggccaccctgctgtgcctgctgctggcggcggcggtccccacggcccccgcgcccgctccgacggcgacctcggctccagtcaagcccggcccggctctcagctacccgcaggaggaggccaccctcaatgagatgttccgcgaggttgaggaactgatggaggacacgcagcacaaattgcgcagcgcggtggaagagatggaggcagaagaagctgctgctaaagcatcatcagaagtgaacctggcaaacttacctcccagctatcacaatgagaccaacacagacacgaaggttggaaataataccatccatgtgcaccgagaaattcacaagataaccaacaaccagactggacaaatggtcttttcagagacagttatcacatctgtgggagacgaagaaggcagaaggagccacgagtgcatcatcgacgaggactgtgggcccagcatgtactgccagtttgccagcttccagtacacctgccagccatgccggggccagaggatgctctgcacccgggacagtgagtgctgtggagaccagctgtgtgtctggggtcactgcaccaaaatggccaccaggggcagcaatgggaccatctgtgacaaccagagggactgccagccggggctgtgctgtgccttccagagaggcctgctgttccctgtgtgcacacccctgcccgtggagggcgagctttgccatgaccccgccagccggcttctggacctcatcacctgggagctagagcctgatggagccttggaccgatgcccttgtgccagtggcctcctctgccagccccacagccacagcctggtgtatgtgtgcaagccgaccttcgtggggagccgtgaccaagatggggagatcctgctgcccagagaggtccccgatgagtatgaagttggcagcttcatggaggaggtgcgccaggagctggaggacctggagaggagcctgactgaagagatggcgctgggggagcctgcggctgccgccgctgcactgctgggaggggaagagatttagatctggaccaggctgtgggtagatgtgcaatagaaatagctaatttatttccccaggtgtgtgctttaggcgtgggctgaccaggcttcttcctacatcttcttcccagtaagtttcccctctggcttgacagcatgaggtgttgtgcatttgttcagctcccccaggctgttctccaggcttcacagtctggtgcttgggagagtcaggcagggttaaactgcaggagcagtttgccacccctgtccagattattggctgctttgcctctaccagttggcagacagccgtttgttctacatggctttgataattgtttgaggggaggagatggaaacaatgtggagtctccctctgattggttttggggaaatgtggagaagagtgccctgctttgcaaacatcaacctggcaaaaatgcaacaaatgaattttccacgcagttctttccatgggcataggtaagctgtgccttcagctgttgcagatgaaatgttctgttcaccctgcattacatgtgtttattcatccagcagtgttgctcagctcctacctctgtgccagggcagcattttcatatccaagatcaattccctctctcagcacagcctggggagggggtcattgttctcctcgtccatcagggatctcagaggctcagagactgcaagctgcttgcccaagtcacacagctagtgaagaccagagcagtttcatctggttgtgactctaagctcagtgctctctccactaccccacaccagccttggtgccaccaaaagtgctccccaaaaggaaggagaatgggatttttcttgaggcatgcacatctggaattaaggtcaaactaattctcacatccctctaaaagtaaactactgttaggaacagcagtgttctcacagtgtggggcagccgtccttctaatgaagacaatgatattgacactgtccctctttggcagttgcattagtaactttgaaaggtatatgactgagcgtagcatacaggttaacctgcagaaacagtacttaggtaattgtagggcgaggattataaatgaaatttgcaaaatcacttagcagcaactgaagacaattatcaaccacgtggagaaaatcaaaccgagcagggctgtgtgaaacatggttgtaatatgcgactgcgaacactgaactctacgccactccacaaatgatgttttcaggtgtcatggactgttgccaccatgtattcatccagagttcttaaagtttaaagttgcacatgattgtataagcatgctttctttgagttttaaattatgtataaacataagttgcatttagaaatcaagcataaatcacttcaactgcaaaaaaaaaaaaaaaaaaaaaaaaaa

SEQ ID NO: 50 - protein, 350 aa, Homo sapiens
MQRLGATLLCLLLAAAVPTAPAPAPTATSAPVKPGPALSYPQEEATLNEMFREVEELMEDTQHKLRSAVEEMEAEEAAAKASSEVNLANLPPSYHNETNTDTKVGNNTIHVHREIHKITNNQTGQMVFSETVITSVGDEEGRRSHECIIDEDCGPSMYCQFASFQYTCQPCRGQRMLCTRDSECCGDQLCVWGHCTKMATRGSNGTICDNQRDCQPGLCCAFQRGLLFPVCTPLPVEGELCHDPASRLLDLITWELEPDGALDRCPCASGLLCQPHSHSLVYVCKPTFVGSRDQDGEILLPREVPDEYEVGSFMEEVRQELEDLERSLTEEMALGEPAAAAAALLGGEEI

SEQ ID NO: 51 - DNA, 1650 bp, Homo sapiens
gcctgttgctgatgctgccgtgcggtacttgtcatggagctggcactgcggcgctctcccgtcccgcggtggttgctgctgctgccgctgctgctgggcctgaacgcaggagctgtcattgactggcccacagaggagggcaaggaagtatgggattatgtgacggtccgcaaggatgcctacatgttctggtggctctattatgccaccaactcctgcaagaacttctcagaactgcccctggtcatgtggcttcagggcggtccaggcggttctagcactggatttggaaactttgaggaaattgggccccttgacagtgatctcaaaccacggaaaaccacctggctccaggctgccagtctcctatttgtggataatcccgtgggcactgggttcagttatgtgaatggtagtggtgcctatgccaaggacctggctatggtggcttcagacatgatggttctcctgaagaccttcttcagttgccacaaagaattccagacagttccattctacattttctcagagtcctatggaggaaaaatggcagctggcattggtctagagctttataaggccattcagcgagggaccatcaagtgcaactttgcgggggttgccttgggtgattcctggatctcccctgttgattcggtgctctcctggggaccttacctgtacagcatgtctcttctcgaagacaaaggtctggcagaggtgtctaaggttgcagagcaagtactgaatgccgtaaataaggggctctacagagaggccacagagctgtgggggaaagcagaaatgatcattgaacagaacacagatggggtgaacttctataacatcttaactaaaagcactcccacgtctacaatggagtcgagtctagaattcacacagagccacctagtttgtctttgtcagcgccacgtgagacacctacaacgagatgccttaagccagctcatgaatggccccatcagaaagaagctcaaaattattcctgaggatcaatcctggggaggccaggctaccaacgtctttgtgaacatggaggaggacttcatgaagccagtcattagcattgtggacgagttgctggaggcagggatcaacgtgacggtgtataatggacagctggatctcatcgtagataccatgggtcaggaggcctgggtgcggaaactgaagtggccagaactgcctaaattcagtcagctgaagtggaaggccctgtacagtgaccctaaatctttggaaacatctgcttttgtcaagtcctacaagaaccttgctttctactggattctgaaagctggtcatatggttccttctgaccaaggggacatggctctgaagatgatgagactggtgactcagcaagaataggatggatggggctggagatgagctggtttggccttggggcacagagctgagctgaggccgctgaagctgtaggaagcgccattcttccctgtatctaactggggctgtgatcaagaaggttctgaccagcttctgcagaggataaaatcattgtctctggaggcaatttggaaattatttctgcttcttaaaaaaacctaagattttttaaaaaattgatttgttttgatcaaaataaaggatgataatagatattaa

SEQ ID NO: 52 - protein, 452 aa, Homo sapiens
MELALRRSPVPRWLLLLPLLLGLNAGAVIDWPTEEGKEVWDYVTVRKDAYMFWWLYYATNSCKNFSELPLVMWLQGGPGGSSTGFGNFEEIGPLDSDLKPRKTTWLQAASLLFVDNPVGTGFSYVNGSGAYAKDLAMVASDMMVLLKTFFSCHKEFQTVPFYIFSESYGGKMAAGIGLELYKAIQRGTIKCNFAGVALGDSWISPVDSVLSWGPYLYSMSLLEDKGLAEVSKVAEQVLNAVNKGLYREATELWGKAEMIIEQNTDGVNFYNILTKSTPTSTMESSLEFTQSHLVCLCQRHVRHLQRDALSQLMNGPIRKKLKIIPEDQSWGGQATNVFVNMEEDFMKPVISIVDELLEAGINVTVYNGQLDLIVDTMGQEAWVRKLKWPELPKFSQLKWKALYSDPKSLETSAFVKSYKNLAFYWILKAGHMVPSDQGDMALKMMRLVTQQE

SEQ ID NO: 53 - DNA, 1857 bp, Homo sapiens
gtctgttcccaggagtccttcggcggctgttgtgtcagtggcctgatcgcgatggggacaaaggcgcaagtcgagaggaaactgttgtgcctcttcatattggcgatcctgttgtgctccctggcattgggcagtgttacagtgcactcttctgaacctgaagtcagaattcctgagaataatcctgtgaagttgtcctgtgcctactcgggcttttcttctccccgtgtggagtggaagtttgaccaaggagacaccaccagactcgtttgctataataacaagatcacagcttcctatgaggaccgggtgaccttcttgccaactggtatcaccttcaagtccgtgacacgggaagacactgggacatacacttgtatggtctctgaggaaggcggcaacagctatggggaggtcaaggtcaagctcatcgtgcttgtgcctccatccaagcctacagttaacatcccctcctctgccaccattgggaaccgggcagtgctgacatgctcagaacaagatggttccccaccttctgaatacacctggttcaaagatgggatagtgatgcctacgaatcccaaaagcacccgtgccttcagcaactcttcctatgtcctgaatcccacaacaggagagctggtctttgatcccctgtcagcctctgatactggagaatacagctgtgaggcacggaatgggtatgggacacccatgacttcaaatgctgtgcgcatggaagctgtggagcggaatgtgggggtcatcgtggcagccgtccttgtaaccctgattctcctgggaatcttggtttttggcatctggtttgcctatagccgaggccactttgacagaacaaagaaagggacttcgagtaagaaggtgatttacagccagcctagtgcccgaagtgaaggagaattcaaacagacctcgtcattcctggtgtgagcctggtcggctcaccgcctatcatctgcatttgccttactcaggtgctaccggactctggcccctgatgtctgtagtttcacaggatgccttatttgtcttctacaccccacagggccccctacttcttcggatgtgtttttaataatgtcagctatgtgccccatcctccttcatgccctccctccctttcctaccactgctgagtggcctggaacttgtttaaagtgtttattccccatttctttgagggatcaggaaggaatcctgggtatgccattgacttcccttctaagtagacagcaaaaatggcgggggtcgcaggaatctgcactcaactgcccacctggctggcagggatctttgaataggtatcttgagcttggttctgggctctttccttgtgtactgacgaccagggccagctgttctagagcgggaattagaggctagagcggctgaaatggttgtttggtgatgacactggggtccttccatctctggggcccactctcttctgtcttcccatgggaagtgccactgggatccctctgccctgtcctcctgaatacaagctgactgacattgactgtgtctgtggaaaatgggagctcttgttgtggagagcatagtaaattttcagagaacttgaagccaaaaggatttaaaaccgctgctctaaagaaaagaaaactggaggctgggcgcagtggctcacgcctgtaatcccagaggctgaggcaggcggatcacctgaggtcgggagttcgggatcagcctgaccaacatggagaaaccctactggaaatacaaagttagccaggcatggtggtgcatgcctgtagtcccagctgctcaggagcctggcaacaagagcaaaactccagctcaaaaaaaaaaaaaaaa

SEQ ID NO: 54 - protein, 299 aa, Homo sapiens
MGTKAQVERKLLCLFILAILLCSLALGSVTVHSSEPEVRIPENNPVKLSCAYSGFSSPRVEWKFDQGDTTRLVCYNNKITASYEDRVTFLPTGITFKSVTREDTGTYTCMVSEEGGNSYGEVKVKLIVLVPPSKPTVNIPSSATIGNRAVLTCSEQDGSPPSEYTWFKDGIVMPTNPKSTRAFSNSSYVLNPTTGELVFDPLSASDTGEYSCEARNGYGTPMTSNAVRMEAVERNVGVIVAAVLVTLILLGILVFGIWFAYSRGHFDRTKKGTSSKKVIYSQPSARSEGEFKQTSSFLV

SEQ ID NO: 55 - DNA, 1679 bp, Homo sapiens
gttgtgtccttcagcaaaacagtggatttaaatctccttgcacaagcttgagagcaacacaatctatcaggaaagaaagaaagaaaaaaaccgaacctgacaaaaaagaagaaaaagaagaagaaaaaaaatcatgaaaaccatccagccaaaaatgcacaattctatctcttgggcaatcttcacggggctggctgctctgtgtctcttccaaggagtgcccgtgcgcagcggagatgccaccttccccaaagctatggacaacgtgacggtccggcagggggagagcgccaccctcaggtgcactattgacaaccgggtcacccgggtggcctggctaaaccgcagcaccatcctctatgctgggaatgacaagtggtgcctggatcctcgcgtggtccttctgagcaacacccaaacgcagtacagcatcgagatccagaacgtggatgtgtatgacgagggcccttacacctgctcggtgcagacagacaaccacccaaagacctctagggtccacctcattgtgcaagtatctcccaaaattgtagagatttcttcagatatctccattaatgaagggaacaatattagcctcacctgcatagcaactggtagaccagagcctacggttacttggagacacatctctcccaaagcggttggctttgtgagtgaagacgaatacttggaaattcagggcatcacccgggagcagtcaggggactacgagtgcagtgcctccaatgacgtggccgcgcccgtggtacggagagtaaaggtcaccgtgaactatccaccatacatttcagaagccaagggtacaggtgtccccgtgggacaaaaggggacactgcagtgtgaagcctcagcagtcccctcagcagaattccagtggtacaaggatgacaaaagactgattgaaggaaagaaaggggtgaaagtggaaaacagacctttcctctcaaaactcatcttcttcaatgtctctgaacatgactatgggaactacacttgcgtggcctccaacaagctgggccacaccaatgccagcatcatgctatttggtccaggcgccgtcagcgaggtgagcaacggcacgtcgaggagggcaggctgcgtctggctgctgcctcttctggtcttgcacctgcttctcaaattttgatgtgagtgccacttccccacccgggaaaggctgccgccaccaccaccaccaacacaacagcaatggcaacaccgacagcaaccaatcagatatatacaaatgaaattagaagaaacacagcctcatgggacagaaatttgagggaggggaacaaagaatactttggggggaaaagagttttaaaaaagaaattgaaaattgccttgcagatatttaggtacaatggagttttcttttcccaaacgggaagaacacagcacacccggcttggacccactgcaagctgcatcgtgcaacctctttggtgccagtgtgggcaagggctcagcctctctgcccacagagtgcccccacgtggaacattctggagctggccatcccaaattcaatcagtccatagagacgaacagaatgagaccttccggcccaagcgtggcgctgcgggcactttggtagactgtgccaccacggcgtgtgttgtgaaacgtgaaataaaaagagcaaaaaaaaa

SEQ ID NO: 56 - protein, 344 aa, Homo sapiens
MKTIQPKMHNSISWAIFTGLAALCLFQGVPVRSGDATFPKAMDNVTVRQGESATLRCTIDNRVTRVAWLNRSTILYAGNDKWCLDPRVVLLSNTQTQYSIEIQNVDVYDEGPYTCSVQTDNHPKTSRVHLIVQVSPKIVEISSDISINEGNNISLTCIATGRPEPTVTWRHISPKAVGFVSEDEYLEIQGITREQSGDYECSASNDVAAPVVRRVKVTVNYPPYISEAKGTGVPVGQKGTLQCEASAVPSAEFQWYKDDKRLIEGKKGVKVENRPFLSKLIFFNVSEHDYGNYTCVASNKLGHTNASIMLFGPGAVSEVSNGTSRRAGCVWLLPLLVLHLLLKF

SEQ ID NO: 57 - DNA, 1777 bp, Homo sapiens
  unsure 439, 647: unknown base
gctgcgccggctgcggctgcaggggaatccgctgtggtgcggctgccaggcgcggcccctactcgagtggctggcgcgggcgcgcgtgcgctcggacggcgcgtgccaggggccgcggcgcctgcggggcgaggctctggacgccctgcggccctgggacctgcgctgccctggggacgcggcgcaggaagaggaagagctggaagagcgggctgtggccgggccccgcgcccctccgcgcggccctccgcgcggccccggggaggagcgggcagtcgcgccttgccctcgcgcctgcgtgtgcgtccccgagtcccggcacagcagctgcgagggctgcggcctgcaggcggtgccccgcggcttccccagcgacacccagctcctggacctgaggcggaaccacttcccctcggtgccccgagcggccttccccggnctgggccacctggtgtcgctgcacctgcagcactgcggcatcgcggagctggaagcgggcgccctggccgggctgggccgcctgatctacctgtacctctccgacaaccagctcgcaggcctcagcgctgctgcccttgaaggggctccccgcctcggctacctgtacctagaacgcaaccgtttcctgcaggtgccaggggctgccntgcgcgccctgcccagcctcttctccctgcacctgcaggacaacgctgtggaccgcctggcacctggggacctggggagaacacgggccttgcgctgggtctacctgagtggaaaccgcatcaccgaagtgtcccttggggcgctgggcccagctcgggagctggagaagctgcacctggacaggaatcagctgcgagaggtgcccactggggccttggaggggctgcctgccctcctggagctgcagctctcgggcaacccactcagggccttgcgtgacggagccttccagcctgtgggcaggtcgctgcagcacctcttcctgaacagcagtggcctggagcagatttgtcctggggccttttcaggcctggggcccgggctccagagcctgcacctgcagaagaaccagcttcgggccctgcctgccctgcccagtctcagccagctggagctcatcgacctcagcagcaatcccttcccctgtgactgccagctgcttccgctgcacaggtggcttactgggctgaacctgcgggtgggggccacctgcgccacccctcccaatgcccgtggccagagggtgaaggctgcagctgctgtctttgaagactgcccgggctgggctgccagaaaggccaagcggacaccagcctccaggcccagtgccaggagaacccccatcaaaggaagacagtgtggagcagataagaacatcctcttccccacatggtaccacactgtggagcccacctcgctgtcataggcctgcggctctgaaggatggctttgcccgctcccgctctgcccctcaagtggaacccaagctgggctcagaatctgtagagtgaggccccaccaagggaaacgacacccacggcctgagagccaggtggagtcctgccactcagctgcctgcctttgctcccaccctctcccaccctcaaagaggtctcgaggggacactctgaaggcacctggctcagaaccactgccatccaaggagcgaggagtcccagggctgagcaaatgcagcggggaggtcggcagttcccctgcttcccgatcctcattttctgcttcacttgactcctccagataggagctgctctcactgcccacactgctg

SEQ ID NO: 58 - protein, 470 aa, Homo sapiens
  unsure 216: unknown amino acid
LRRLRLQGNPLWCGCQARPLLEWLARARVRSDGACQGPRRLRGEALDALRPWDLRCPGDAAQEEEELEERAVAGPRAPPRGPPRGPGEERAVAPCPRACVCVPESRHSSCEGCGLQAVPRGFPSDTQLLDLRRNHFPSVPRAAFPGLGHLVSLHLQHCGIAELEAGALAGLGRLIYLYLSDNQLAGLSAAALEGAPRLGYLYLERNRFLQVPGAAXRALPSLFSLHLQDNAVDRLAPGDLGRTRALRWVYLSGNRITEVSLGALGPARELEKLHLDRNQLREVPTGALEGLPALLELQLSGNPLRALRDGAFQPVGRSLQHLFLNSSGLEQICPGAFSGLGPGLQSLHLQKNQLRALPALPSLSQLELIDLSSNPFPCDCQLLPLHRWLTGLNLRVGATCATPPNARGQRVKAAAAVFEDCPGWAARKAKRTPASRPSARRTPIKGRQCGADKNILFPTWYHTVEPTSLS

SEQ ID NO: 59 - DNA, 2749 bp, Homo sapiens
  unsure 1869, 1887: unknown base
ctcccacggtgtccagcgcccagaatgcggcttctggtcctgctatggggttgcctgctgctcccaggttatgaagccctggagggcccagaggaaatcagcgggttcgaaggggacactgtgtccctgcagtgcacctacagggaagagctgagggaccaccggaagtactggtgcaggaagggtgggatcctcttctctcgctgctctggcaccatctatgcagaagaagaaggccaggagacaatgaagggcagggtgtccatccgtgacagccgccaggagctctcgctcattgtgaccctgtggaacctcaccctgcaagacgctggggagtactggtgtggggtcgaaaaacggggccccgatgagtctttactgatctctctgttcgtctttccaggaccctgctgtcctccctccccttctcccaccttccagcctctggctacaacacgcctgcagcccaaggcaaaagctcagcaaacccagcccccaggattgacttctcctgggctctacccggcagccaccacagccaagcaggggaagacaggggctgaggcccctccattgccagggacttcccagtacgggcacgaaaggacttctcagtacacaggaacctctcctcacccagcgacctctcctcctgcagggagctcccgcccccccatgcagctggactccacctcagcagaggacaccagtccagctctcagcagtggcagctctaagcccagggtgtccatcccgatggtccgcatactggccccagtcctggtgctgctgagccttctgtcagccgcaggcctgatcgccttctgcagccacctgctcctgtggagaaaggaagctcaacaggccacggagacacagaggaacgagaagttctggctctcacgcttgactgcggaggaaaaggaagccccttcccaggcccctgagggggacgtgatctcgatgcctcccctccacacatctgaggaggagctgggcttctcgaagtttgtctcagcgtagggcaggaggccctcctggccaggccagcagtgaagcagtatggctggctggatcagcaccgattcccgaaagctttccacctcagcctcagagtccagctgcccggactccagggctctccccaccctccccaggctctcctcttgcatgttccagcctgacctagaagcgtttgtcagccctggagcccagagcggtggccttgctcttccggctggagactgggacatccctgataggttcacatccctgggcagagtaccaggctgctgaccctcagcagggccagacaaggctcagtggatctggtctgagtttcaatctgccaggaactcctgggcctcatgcccagtgtcggaccctgccttcctcccactccagaccccaccttgtcttccctccctggcgtcctcagacttagtcccacggtctcctgcatcagctggtgatgaagaggagcatgctggggtgagactgggattctggcttctctttgaaccacctgcatccagcccttcaggaagcctgtgaaaaacgtgattcctggccccaccaagacccaccaaaaccatctctgggcttggtgcaggactctgaattctaacaatgcccagtgactgtcgcacttgagtttgagggccagtgggcctgatgaacgctcacaccccttcagcttagagtctgcatttgggctgtgacgtctccacctgccccaatagatctgctctgtctgcgacaccagatccacgtggggactcccctgaggcctgctaagtccaggccttggtcaggtcaggtgcacattgcaggataagcccaggaccggcacagaagtggttgcctttnccatttgccctccctggnccatgccttcttgcctttggaaaaaatgatgaagaaaaccttggctccttccttgtctggaaagggttacttgcctatgggttctggtggctagagagaaaagtagaaaaccagagtgcacgtaggtgtctaacacagaggagagtaggaacagggcggatacctgaaggtgactccgagtccagccccctggagaaggggtcgggggtggtggtaaagtagcacaactactattttttttctttttccattattattgttttttaagacagaatctcgtgctgctgcccaggctggagtgcagtggcacgatctgcaaactccgcctcctgggttcaagtgattcttctgcctcagcctcccgagtagctgggattacaggcacgcaccaccacacctggctaatttttgtacttttagtagagatggggtttcaccatgttggccaggctggtcttgaactcctgacctcaaatgagcctcctgcttcagtctcccaaattgccgggattacaggcatgagccactgtgtctggccctatttcctttaaaaagtgaaattaagagttgttcagtatgcaaaacttggaaagatggaggagaaaaagaaaaggaagaaaaaaatgtcacccatagtctcaccagagactatcattatttcgttttgttgtacttccttccactcttttcttcttcacataatttgccggtgttctttttacagagcaattatcttgtatatacaactttgtatcctgccttttccaccttatcgttccatcactttattccagcacttctctgtgttttacagacctttttataaataaaatgttcatcagctgcataaaaaaaaaaaaaa

SEQ ID NO: 60 - protein, 332 aa, Homo sapiens [sequence omitted]

SEQ ID NO: 61 - DNA, 1572 bp, Homo sapiens
cgggccagcctggggcggccggccaggaaccacccgttaaggtgtcttctctttagggatggtgaggttggaaaaagactcctgtaaccctcctccaggatgaaccacctgccagaagacatggagaacgctctcaccgggagccagagctcccatgcttctctgcgcaatatccattccatcaaccccacacaactcatggccaggattgagtcctatgaaggaagggaaaagaaaggcatatctgatgtcaggaggactttctgtttgtttgtcacctttgacctcttattcgtaacattactgtggataatagagttaaatgtgaatggaggcattgagaacacattagagaaggaggtgatgcagtatgactactattcttcatattttgatatatttcttctggcagtttttcgatttaaagtgttaatacttgcatatgctgtgtgcagactgcgccattggtgggcaatagcgttgacaacggcagtgaccagtgcctttttactagcaaaagtgatcctttcgaagcttttctctcaaggggcttttggctatgtgctgcccatcatttcattcatccttgcctggattgagacgtggttcctggatttcaaagtgttacctcaagaagcagaagaagaaaacagactcctgatagttcaggatgcttcagagagggcagcacttatacctggtggtctttctgatggtcagttttattcccctcctgaatccgaagcaggatctgaagaagctgaagaaaaacaggacagtgagaaaccacttttagaactatgagtactacttttgttaaatgtgaaaaaccctcacagaaagtcatcgaggcaaaaagaggcaggcagtggagtctccctgtcgacagtaaagttgaaatggtgacgtccactgctggctttattgaacagctaataaagatttatttattgtaatacctcacaaacgttgtaccatatccatgcacatttagttgcctgcctgtggctggtaaggtaatgtcatgattcatcctctcttcagtgagactgagcctgatgtgttaacaaataggtgaagaaagtcttgtgctgtattcctaatcaaaagacttaatatattgaagtaacacttttttagtaagcaagatacctttttatttcaattcacagaatggaatttttttgtttcatgtctcagatttattttgtatttcttttttaacactctacatttcccttgttttttaactcatgcacatgtgctctttgtacagttttaaaaagtgtaataaaatctgacatgtcaatgtggctagttttatttttcttgttttgcattatgtgtatggcctgaagtgttggacttgcaaaaggggaagaaaggaattgcgaatacatgtaaaatgtcaccagacatttgtattatttttatcatgaaatcatgtttttctctgattgttctgaaatgttctaaatactcttattttgaatgcacaaaatgacttaaaccattcatatcatgtttcctttgcgttcagccaatttcaattaaaatgaactaaattaaaaa

SEQ ID NO: 62 - protein, 234 aa, Homo sapiens
MNHLPEDMENALTGSQSSHASLRNIHSINPTQLMARIESYEGREKKGISDVRRTFCLFVTFDLLFVTLLWIIELNVNGGIENTLEKEVMQYDYYSSYFDIFLLAVFRFKVLILAYAVCRLRHWWAIALTTAVTSAFLLAKVILSKLFSQGAFGYVLPIISFILAWIETWFLDFKVLPQEAEEENRLLIVQDASERAALIPGGLSDGQFYSPPESEAGSEEAEEKQDSEKPLLEL

SEQ ID NO: 63 - DNA, 2458 bp, Homo sapiens
gcgccgggagcccatctgcccccaggggcacggggcgcggggccggctcccgcccggcacatggctgcagccacctcgcgcgcaccccgaggcgccgcgcccagctcgcccgaggtccgtcggaggcgcccggccgccccggagccaagcagcaactgagcggggaagcgcccgcgtccggggatcgggatgtccctcctccttctcctcttgctagtttcctactatgttggaaccttggggactcacactgagatcaagagagtggcagaggaaaaggtcactttgccctgccaccatcaactggggcttccagaaaaagacactctggatattgaatggctgctcaccgataatgaagggaaccaaaaagtggtgatcacttactccagtcgtcatgtctacaataacttgactgaggaacagaagggccgagtggcctttgcttccaatttcctggcaggagatgcctccttgcagattgaacctctgaagcccagtgatgagggccggtacacctgtaaggttaagaattcagggcgctacgtgtggagccatgtcatcttaaaagtcttagtgagaccatccaagcccaagtgtgagttggaaggagagctgacagaaggaagtgacctgactttgcagtgtgagtcatcctctggcacagagcccattgtgtattactggcagcgaatccgagagaaagagggagaggatgaacgtctgcctcccaaatctaggattgactacaaccaccctggacgagttctgctgcagaatcttaccatgtcctactctggactgtaccagtgcacagcaggcaacgaagctgggaaggaaagctgtgtggtgcgagtaactgtacagtatgtacaaagcatcggcatggttgcaggagcagtgacaggcatagtggctggagccctgctgattttcctcttggtgtggctgctaatccgaaggaaagacaaagaaagatatgaggaagaagagagacctaatgaaattcgagaagatgctgaagctccaaaagcccgtcttgtgaaacccagctcctcttcctcaggctctcggagctcacgctctggttcttcctccactcgctccacagcaaatagtgcctcacgcagccagcggacactgtcaactgacgcagcaccccagccagggctggccacccaggcatacagcctagtggggccagaggtgagaggttctgaaccaaagaaagtccaccatgctaatctgaccaaagcagaaaccacacccagcatgatccccagccagagcagagccttccaaacggtctgaattacaatggacttgactcccacgctttcctaggagtcagggtctttggactcttctcgtcattggagctcaagtcaccagccacacaaccagatgagaggtcatctaagtagcagtgagcattgcacggaacagattcagatgagcattttccttatacaataccaaacaagcaaaaggatgtaagctgattcatctgtaaaaaggcatcttattgtgcctttagaccagagtaagggaaagcaggagtccaaatctatttgttgaccaggacctgtggtgagaaggttggggaaaggtgaggtgaatatacctaaaacttttaatgtgggatattttgtatcagtgctttgattcacaattttcaagaggaaatgggatgctgtttgtaaattttctatgcatttctgcaaacttattggattattagttattcagacagtcaagcagaacccacagccttattacacctgtctacaccatgtactgagctaaccacttctaagaaactccaaaaaaggaaacatgtgtcttctattctgacttaacttcatttgtcataaggtttggatattaatttcaaggggagttgaaatagtgggagatggagaagagtgaatgagtttctcccactctatactaatctcactatttgtattgagcccaaaataactatgaaaggagacaaaaatttgtgacaaaggattgtgaagagctttccatcttcatgatgttatgaggattgttgacaaacattagaaatatataatggagcaattgtggatttcccctcaaatcagatgcctctaaggactttcctgctagatatttctggaaggagaaaatacaacatgtcatttatcaacgtccttagaaagaattcttctagagaaaaagggatctaggaatgctgaaagattacccaacataccattatagtctcttctttctgagaaaatgtgaaaccagaattgcaagactgggtggactagaaagggagattagatcagttttctcttaatatgtcaaggaaggtagccgggcatggtgccaggcacctgtaggaaaatccagcaggtggaggttgcagtgagccgagattatgccattgcactccagcctgggtgacagagcgggactccgtctc

SEQ ID NO: 64 - protein, 373 aa, Homo sapiens
MSLLLLLLLVSYYVGTLGTHTEIKRVAEEKVTLPCHHQLGLPEKDTLDIEWLLTDNEGNQKVVITYSSRHVYNNLTEEQKGRVAFASNFLAGDASLQIEPLKPSDEGRYTCKVKNSGRYVWSHVILKVLVRPSKPKCELEGELTEGSDLTLQCESSSGTEPIVYYWQRIREKEGEDERLPPKSRIDYNHPGRVLLQNLTMSYSGLYQCTAGNEAGKESCVVRVTVQYVQSIGMVAGAVTGIVAGALLIFLLVWLLIRRKDKERYEEEERPNEIREDAEAPKARLVKPSSSSSGSRSSRSGSSSTRSTANSASRSQRTLSTDAAPQPGLATQAYSLVGPEVRGSEPKKVHHANLTKAETTPSMIPSQSRAFQTV

SEQ ID NO: 65 - DNA, 1728 bp, Homo sapiens
gtcggggctgcgcgacggcgcaggggctgcggggagcgccgcgcaggccgtgcagttcctagcgaggaggcgccgccgccattgccgctctctcggtgagcgcagccccgctctccgggccgggccttcgcgggccaccggcgccatgggccagtgcggcatcacctcctccaagaccgtgctggtctttctcaacctcatcttctggggggcagctggcattttatgctatgtgggagcctatgtcttcatcacttatgatgactatgaccacttctttgaagatgtgtacacgctcatccctgctgtagtgatcatagctgtaggagccctgcttttcatcattgggctaattggctgctgtgccacaatccgggaaagtcgctgtggacttgccacgtttgtcatcatcctgctcttggtttttgtcacagaagttgttgtagtggttttgggatatgtttacagagcaaaggtggaaaatgaggttgatcgcagcattcagaaagtgtataagacctacaatggaaccaaccctgatgctgctagccgggctattgattatgtacagagacagctgcattgttgtggaattcacaactactcagactgggaaaatacagattggttcaaagaaaccaaaaaccagagtgtccctcttagctgctgcagagagactgccagcaattgtaatggcagcctggcccacccttccgacctctatgctgaggggtgtgaggctctagtagtgaagaagctacaagaaatcatgatgcatgtgatctgggccgcactggcatttgcagctattcagctgctgggcatgctgtgtgcttgcatcgtgttgtgcagaaggagtagagatcctgcttacgagctcctcatcactggcggaacctatgcatagttgacaactcaagcctgagctttttggtcttgttctgatttggaaggtgaattgagcaggtctgctgctgttggcctctggagttcatttagttaaagcacatgtacactggtgttggacagagcagcttggcttttcatgtgcccacctacttacctactacctgcgactttctttttccttgttctagctgactcttcatgcccctaagattttaagtacgatggtgaacgttctaatttcagaaccaattgcgagtcatgtagtgtggtagaattaaaggaggacacgagcctgcttctgttacctccaagtggtaacaggactgatgccgaaatgtcaccaggtcctttcagtcttcacagtggagaactcttggccaaaggtttttgcggggaggaggaggaaaccagctttctggttaaggttaacaccagatggtgcccctcattggtgtccttttaaaaaatatttactgtagtccaataagatagcagctgtacaaaatgactaaaatagattgtaggatcatatggcgtatatcttggttcatcttcaaaatcagagactgagctttgaaactagtggtttttaatcaaagttggctttataggaggagtataatgtatgcactactgttttaaaagaattagtgtgagtgtgtttttgtatgaatgagcccattcatggtaagtcttaagcttgttggaaataatgtacccatgtagactagcaaaatagtatgtagatgtgatctcagttgtaaatagaaaaatctaattcaataaactctgtatcagcccccaaaaaaaaaaaaaaaa

SEQ ID NO: 66 - protein, 253 aa, Homo sapiens
MGQCGITSSKTVLVFLNLIFWGAAGILCYVGAYVFITYDDYDHFFEDVYTLIPAVVIIAVGALLFIIGLIGCCATIRESRCGLATFVIILLLVFVTEVVVVVLGYVYRAKVENEVDRSIQKVYKTYNGTNPDAASRAIDYVQRQLHCCGIHNYSDWENTDWFKETKNQSVPLSCCRETASNCNGSLAHPSDLYAEGCEALVVKKLQEIMMHVIWAALAFAAIQLLGMLCACIVLCRRSRDPAYELLITGGTYA

SEQ ID NO: 67 - DNA, 963 bp, Homo sapiens
gcggcacctggaagatgcgcccattggctggtggcctgctcaaggtggtgttcgtggtcttcgcctccttgtgtgcctggtattcggggtacctgctcgcagagctcattccagatgcacccctgtccagtgctgcctatagcatccgcagcatcggggagaggcctgtcctcaaagctccagtccccaaaaggcaaaaatgtgaccactggactccctgcccatctgacacctatgcctacaggttactcagcggaggtggcagaagcaagtacgccaaaatctgctttgaggataacctacttatgggagaacagctgggaaatgttgccagaggaataaacattgccattgtcaactatgtaactgggaatgtgacagcaacacgatgttttgatatgtatgaaggcgataactctggaccgatgacaaagtttattcagagtgctgctccaaaatccctgctcttcatggtgacctatgacgacggaagcacaagactgaataacgatgccaagaatgccatagaagcacttggaagtaaagaaatcaggaacatgaaattcaggtctagctgggtatttattgcagcaaaaggcttggaactcccttccgaaattcagagagaaaagatcaaccactctgatgctaagaacaacagatattctggctggcctgcagagatccagatagaaggctgcatacccaaagaacgaagctgacactgcagggtcctgagtaaatgtgttctgtataaacaaatgcagctggaatcgctcaagaatcttatttttctaaatccaacagcccatatttgatgagtattttgggtttgttgtaaaccaatgaacatttgctagttgtatcaaatcttggtacgcagtatttttataccagtattttatgtagtgaagatgtcaattagcaggaaactaaaatgaatggaaattcttaaaaaaaaaa

SEQ ID NO: 68 - protein, 235 aa, Homo sapiens
MRPLAGGLLKVVFVVFASLCAWYSGYLLAELIPDAPLSSAAYSIRSIGERPVLKAPVPKRQKCDHWTPCPSDTYAYRLLSGGGRSKYAKICFEDNLLMGEQLGNVARGINIAIVNYVTGNVTATRCFDMYEGDNSGPMTKFIQSAAPKSLLFMVTYDDGSTRLNNDAKNAIEALGSKEIRNMKFRSSWVFIAAKGLELPSEIQREKINHSDAKNNRYSGWPAEIQIEGCIPKERS

SEQ ID NO: 69 - DNA, 1091 bp, Homo sapiens
acacaactttacacctgaatgaacgccaaacctctatggatatataaagggaagcttgaggaggaatttcacagttacagtgcagaagcagaagcaaaagaattaaccagctcttcagtcaagcaaatcctctactcaccatgcttcctcctgccattcatttctatctccttccccttgcatgcatcctaatgaaaagctgtttggcttttaaaaatgatgccacagaaatcctttattcacatgtggttaaacctgttccagcacaccccagcagcaacagcacgttgaatcaagccagaaatggaggcaggcatttcagtaacactggactggatcggaacactcgggttcaagtgggttgccgggaactgcgttccaccaaatacatctctgatggccagtgcaccagcatcagccctctgaaggagctggtgtgtgctggcgagtgcttgcccctgccagtgctccctaactggattggaggaggctatggaacaaagtactggagcaggaggagctcccaggagtggcggtgtgtcaatgacaaaacccgtacccagagaatccagctgcagtgccaagatggcagcacacgcacctacaaaatcacagtagtcactgcctgcaagtgcaagaggtacacccggcagcacaacgagtccagtcacaactttgagagcatgtcacctgccaagccagtccagcatcacagagagcggaaaagagccagcaaatccagcaagcacagcatgagttagaactcagactcccataactagacttactagtaaccatctgctttacagatttgattgcttggaagactcaagcctgccactgctgttttctcacttgaaagtatatgctttctgctttgatcaaacccagcaagctgtcttaagtatcaggaccttctttgggaatagtttttccttttaaagtttttcaagatgtaggtatatccatgaatgcaatttgcatttaaattccacgtatccctgtagtttaaattcctcattggtcttaaaagactgttgatactataaacatcagtggaatcaattatattttaaaacagaaaagggctt

SEQ ID NO: 70 - protein, 206 aa, Homo sapiens
MLPPAIHFYLLPLACILMKSCLAFKNDATEILYSHVVKPVPAHPSSNSTLNQARNGGRHFSNTGLDRNTRVQVGCRELRSTKYISDGQCTSISPLKELVCAGECLPLPVLPNWIGGGYGTKYWSRRSSQEWRCVNDKTRTQRIQLQCQDGSTRTYKITVVTACKCKRYTRQHNESSHNFESMSPAKPVQHHRERKRASKSSKHSMS

SEQ ID NO: 71 - DNA, 999 bp, Homo sapiens
cccaggctctagtgcaggaggagaaggaggaggagcaggaggtggagattcccagttaaaaggctccagaatcgtgtaccaggcagagaactgaagtactggggcctcctccactgggtccgaatcagtaggtgaccccgcccctggattctggaagacctcaccatgggacgcccccgacctcgtgcggccaagacgtggatgttcctgctcttgctggggggagcctgggcaggacactccagggcacaggaggacaaggtgctggggggtcatgagtgccaaccccattcgcagccttggcaggcggccttgttccagggccagcaactactctgtggcggtgtccttgtaggtggcaactgggtccttacagctgcccactgtaaaaaaccgaaatacacagtacgcctgggagaccacagcctacagaataaagatggcccagagcaagaaatacctgtggttcagtccatcccacacccctgctacaacagcagcgatgtggaggaccacaaccatgatctgatgcttcttcaactgcgtgaccaggcatccctggggtccaaagtgaagcccatcagcctggcagatcattgcacccagcctggccagaagtgcaccgtctcaggctggggcactgtcaccagtccccgagagaattttcctgacactctcaactgtgcagaagtaaaaatctttccccagaagaagtgtgaggatgcttacccggggcagatcacagatggcatggtctgtgcaggcagcagcaaaggggctgacacgtgccagggcgattctggaggccccctggtgtgtgatggtgcactccagggcatcacatcctggggctcagacccctgtgggaggtccgacaaacctggcgtctataccaacatctgccgctacctggactggatcaagaagatcataggcagcaagggctgattctaggataagcactagatctcccttaataaactcacaactctctggttc

SEQ ID NO: 72 - protein, 260 aa, Homo sapiens
MGRPRPRAAKTWMFLLLLGGAWAGHSRAQEDKVLGGHECQPHSQPWQAALFQGQQLLCGGVLVGGNWVLTAAHCKKPKYTVRLGDHSLQNKDGPEQEIPVVQSIPHPCYNSSDVEDHNHDLMLLQLRDQASLGSKVKPISLADHCTQPGQKCTVSGWGTVTSPRENFPDTLNCAEVKIFPQKKCEDAYPGQITDGMVCAGSSKGADTCQGDSGGPLVCDGALQGITSWGSDPCGRSDKPGVYTNICRYLDWIKKIIGSKG

SEQ ID NO: 73 - DNA, 3906 bp, Homo sapiens
ctcgggcgcgcacaggcagctcggtttgccctgcgattgagctgcgggtcgcggccggcgccggcctctccaatggcaaatgtgtgtggctggaggcgagcgcgaggctttcggcaaaggcagtcgagtgtttgcagaccggggcgagtcctgtgaaagcagataaaagaaaacatttattaacgtgtcattacgaggggagcgcccggccggggctgtcgcactccccgcggaacatttggctccctccagctccgagagaggagaagaagaaagcggaaaagaggcagattcacgtcgtttccagccaagtggacctgatcgatggccctcctgaatttatcacgatatttgatttattagcgatgccccctggtttgtgtgttacgcacacacacgtgcacacaaggctctggctcgcttccctccctcgtttccagctcctgggcgaatcccacatctgtttcaactctccgccgagggcgagcaggagcgagagtgtgtcgaatctgcgagtgaagagggacgagggaaaagaaacaaagccacagacgcaacttgagactcccgcatcccaaaagaagcaccagatcagcaaaaaaagaagatgggccccccgagcctcgtgctgtgcttgctgtccgcaactgtgttctccctgctgggtggaagctcggccttcctgtcgcaccaccgcctgaaaggcaggtttcagagggaccgcaggaacatccgccccaacatcatcctggtgctgacggacgaccaggatgtggagctgggttccatgcaggtgatgaacaagacccggcgcatcatggagcagggcggggcgcacttcatcaacgccttcgtgaccacacccatgtgctgcccctcacgctcctccatcctcactggcaagtacgtccacaaccacaacacctacaccaacaatgagaactgctcctcgccctcctggcaggcacagcacgagagccgcacctttgccgtgtacctcaatagcactggctaccggacagctttcttcgggaagtatcttaatgaatacaacggctcctacgtgccacccggctggaaggagtgggtcggactccttaaaaactcccgcttttataactacacgctgtgtcggaacggggtgaaagagaagcacggctccgactactccaaggattacctcacagacctcatcaccaatgacagcgtgagcttcttccgcacgtccaagaagatgtacccgcacaggccagtcctcatggtcatcagccatgcagccccccacggccctgaggattcagccccacaatattcacgcctcttcccaaacgcatctcagcacatcacgccgagctacaactacgcgcccaacccggacaaacactggatcatgcgctacacggggcccatgaagcccatccacatggaattcaccaacatgctccagcggaagcgcttgcagaccctcatgtcggtggacgactccatggagacgatttacaacatgctggttgagacgggcgagctggacaacacgtacatcgtatacaccgccgaccacggttaccacatcggccagtttggcctggtgaaagggaaatccatgccatatgagtttgacatcagggtcccgttctacgtgaggggccccaacgtggaagccggctgtctgaatccccacatcgtcctcaacattgacctggcccccaccatcctggacattgcaggcctggacatacctgcggatatggacgggaaatccatcctcaagctgctggacacggagcggccggtgaatcggtttcacttgaaaaagaagatgagggtctggcgggactccttcttggtggagagaggcaagctgctacacaagagagacaatgacaaggtggacgcccaggaggagaactttctgcccaagtaccagcgtgtgaaggacctgtgtcagcgtgctgagtaccagacggcgtgtgagcagctgggacagaagtggcagtgtgtggaggacgccacggggaagctgaagctgcataagtgcaagggccccatgcggctgggcggcagcagagccctctccaacctcgtgcccaagtactacgggcagggcagcgaggcctgcacctgtgacagcggggactacaagctcagcctggccggacgccggaaaaaactcttcaagaagaagtacaaggccagctatgtccgcagtcgctccatccgctcagtggccatcgaggtggacggcagggtgtaccacgtaggcctgggtgatgccgcccagccccgaaacctcaccaagcggcactggccaggggcccctgaggaccaagatgacaaggatggtggggacttcagtggcactggaggccttcccgactactcagccgccaaccccattaaagtgacacatcggtgctacatcctagagaacgacacagtccagtgtgacctggacctgtacaagtccctgcaggcctggaaagaccacaagctgcacatcgaccacgagattgaaaccctgcagaacaaaattaagaacctgagggaagtccgaggtcacctgaagaaaaagcggccagaagaatgtgactgtcacaaaatcagctaccacacccagcacaaaggccgcctcaagcacagaggctccagtctgcatcctttcaggaagggcctgcaagagaaggacaaggtgtggctgttgcgggagcagaagcgcaagaagaaactccgcaagctgctcaagcgcctgcagaacaacgacacgtgcagcatgccaggcctcacgtgcttcacccacgacaaccagcactggcagacggcgcctttctggacactggggcctttctgtgcctgcaccagcgccaacaataacacgtactggtgcatgaggaccatcaatgagactcacaatttcctcttctgtgaatttgcaactggcttcctagagtactttgatctcaacacagacccctaccagctgatgaatgcagtgaacacactggacagggatgtcctcaaccagctacacgtacagctcatggagctgaggagctgcaagggttacaagcagtgtaacccccggactcgaaacatggacctggatggaggaagctatgagcaatacaggcagtttcagcgtcgaaagtggccagaaatgaagagaccttcttccaaatcactgggacaactgtgggaaggctgggaaggttaagaaacaacagaggtggacctccaaaaacatagaggcatcacctgactgcacaggcaatgaaaaaccatgtgggtgatttccagcagacctgtgctattggccaggaggcctgagaaagcaagcacgcactctcagtcaacatgacagattctggaggataaccagcaggagcagagataacttcaggaagtccatttttgcccctgcttttgctttggattatacctcaccagctgcacaaaatgcattttttcgtatcaaaaagtcaccactaaccctcccccagaagctcacaaaggaaaacggagagagcgagcgagagagatttccttggaaatttctcccaagggcgaaagtcattggaatttttaaatcataggggaaaagcagtcctgttctaaatcctcttattcttttggtttgtcacaaagaaggaactaagaagcaggacagaggcaacgtggagaggctgaaaacagtgcagagacgtttgacaatgagtcagtagcacaaaagagatgacatttacctagcactataaaccctggttgcctctgaagaaactgccttcattgtatatatgtgactatttacatgtaatcaacatgggaacttttaggggaacctaataagaaatcccaattttcaggagtggtggtgtcaataaacgctctgtggccagtgtaaaagaaaaa

SEQ ID NO: 74 - protein, 867 aa, Homo sapiens
MGPPSLVLCLLSATVFSLLGGSSAFLSHHRLKGRFQRDRRNIRPNIILVLTDDQDVELGSMQVMNKTRRIMEQGGAHFINAFVTTPMCCPSRSSILTGKYVHNHNTYTNNENCSSPSWQAQHESRTFAVYLNSTGYRTAFFGKYLNEYNGSYVPPGWKEWVGLLKNSRFYNYTLCRNGVKEKHGSDYSKDYLTDLITNDSVSFFRTSKKMYPHRPVLMVISHAAPHGPEDSAPQYSRLFPNASQHITPSYNYAPNPDKHWIMRYTGPMKPIHMEFTNMLQRKRLQTLMSVDDSMETIYNMLVETGELDNTYIVYTADHGYHIGQFGLVKGKSMPYEFDIRVPFYVRGPNVEAGCLNPHIVLNIDLAPTILDIAGLDIPADMDGKSILKLLDTERPVNRFHLKKKMRVWRDSFLVERGKLLHKRDNDKVDAQEENFLPKYQRVKDLCQRAEYQTACEQLGQKWQCVEDATGKLKLHKCKGPMRLGGSRALSNLVPKYYGQGSEACTCDSGDYKLSLAGRRKKLFKKKYKASYVRSRSIRSVAIEVDGRVYHVGLGDAAQPRNLTKRHWPGAPEDQDDKDGGDFSGTGGLPDYSAANPIKVTHRCYILENDTVQCDLDLYKSLQAWKDHKLHIDHEIETLQNKIKNLREVRGHLKKKRPEECDCHKISYHTQHKGRLKHRGSSLHPFRKGLQEKDKVWLLREQKRKKKLRKLLKRLQNNDTCSMPGLTCFTHDNQHWQTAPFWTLGPFCACTSANNNTYWCMRTINETHNFLFCEFATGFLEYFDLNTDPYQLMNAVNTLDRDVLNQLHVQLMELRSCKGYKQCNPRTRNMDLDGGSYEQYRQFQRRKWPEMKRPSSKSLGQLWEGWEG

SEQ ID NO: 75 - DNA, 1427 bp, Homo sapiens
cccacgcgtccgcccacgcgtccggtggactatgggccagtttttgtgcaagaaccagatgatattatttttccaactgattctgatgaaaagaaggtagcattgaattgtgaagttcgtggcaatccagttcccagttacagatggcttcgaaatggaacagaaatagatctggaaagtgattatcgctacagtttgatagatggcaccttcattataagcaatccaagtgaagcaaaggattctggtcattatcagtgtttagcaaccaacactgtggggagtattcttagtagagaagctacactgcagtttgcctatctgggaaattttagtggccggacaagaagtgcagtctctgtgagggaaggccagggtgtcgttctgatgtgctctcctccgccacattcaccagagatcatctatagctgggtatttaatgagttcccttcctttgtggcggaagacagccggcggttcatctcccaggagacaggcaacctttatatttctaaagtccaaacatcagatgttggcagctatatttgtctggtgaaaaacacagtgacgaatgctagagtccttagtcctccaacgccactcactctgcgtaatgatggtgtgatgggagaatatgagccgaaaattgaggtccattttcctttcacggttacagctgctaaaggaacaactgttaagatggaatgctttgcacttggcaaccccgttccaacaatcacatggatgaaggttaatggttatattcctagtaaggcacgtctgcggaaatctcaggcggtgctggaaataccgaatgtacagctggatgatgcaggcatttatgagtgcagagctgaaaactcacgtggaaaaaattcctttcgtggacaattacaagtatacacctacccacactgggtagaaaaactgaatgatactcagttagacagtgggagccctctccgatgggaatgtaaggctactggaaaacccagacccacgtatcgttggctgaagaatggagtacccctctcacctcagagtagggttgagatggttaatggagtattgatgatccacaatgtgaatcaatcagatgctggaatgtatcagtgtttggctgaaaataagtatggagccatttacgctagtgctgagctgaagattctagcttcagctcccacttttgcactgaatcaactgaagaaaacaataattgttaccaaagaccaagaagttgtcatagagtgcaaaccccaaggctctccaaaaccaaccatctcttggaagaaaggagacagagcagttagagaaaacaaaagaatagctattcttccagacgggagtctacggatcctaaatgcttccaaatcagacgagggaaagtacgtttgccgaggggaaaacgtctttggttctgctgaaat

SEQ ID NO: 76 - protein, 346 aa, Homo sapiens
MCSPPPHSPEIIYSWVFNEFPSFVAEDSRRFISQETGNLYISKVQTSDVGSYICLVKNTVTNARVLSPPTPLTLRNDGVMGEYEPKIEVHFPFTVTAAKGTTVKMECFALGNPVPTITWMKVNGYIPSKARLRKSQAVLEIPNVQLDDAGIYECRAENSRGKNSFRGQLQVYTYPHWVEKLNDTQLDSGSPLRWECKATGKPRPTYRWLKNGVPLSPQSRVEMVNGVLMIHNVNQSDAGMYQCLAENKYGAIYASAELKILASAPTFALNQLKKTIIVTKDQEVVIECKPQGSPKPTISWKKGDRAVRENKRIAILPDGSLRILNASKSDEGKYVCRGENVFGSAE

SEQ ID NO: 77 - DNA, 2137 bp, Homo sapiens
gctcccagccaagaacctcggggccgctgcgcggtggggaggagttccccgaaacccggccgctaagcgaggcctcctcctcccgcagatccgaacggcctgggcggggtcaccccggctgggacaagaagccgccgcctgcctgcccgggcccggggagggggctggggctggggccggaggcggggtgtgagtgggtgtgtgcggggggcggaggcttgatgcaatcccgataagaaatgctcgggtgtcttgggcacctacccgtggggcccgtaaggcgctactatataaggctgccggcccggagccgccgcgccgtcagagcaggagcgctgcgtccaggatctagggccacgaccatcccaacccggcactcacagccccgcagcgcatcccggtcgccgcccagcctcccgcacccccatcgccggagctgcgccgagagccccagggaggtgccatgcggagcgggtgtgtggtggtccacgtatggatcctggccggcctctggctggccgtggccgggcgccccctcgccttctcggacgcggggccccacgtgcactacggctggggcgaccccatccgcctgcggcacctgtacacctccggcccccacgggctctccagctgcttcctgcgcatccgtgccgacggcgtcgtggactgcgcgcggggccagagcgcgcacagtttgctggagatcaaggcagtcgctctgcggaccgtggccatcaagggcgtgcacagcgtgcggtacctctgcatgggcgccgacggcaagatgcaggggctgcttcagtactcggaggaagactgtgctttcgaggaggagatccgcccagatggctacaatgtgtaccgatccgagaagcaccgcctcccggtctccctgagcagtgccaaacagcggcagctgtacaagaacagaggctttcttccactctctcatttcctgcccatgctgcccatggtcccagaggagcctgaggacctcaggggccacttggaatctgacatgttctcttcgcccctggagaccgacagcatggacccatttgggcttgtcaccggactggaggccgtgaggagtcccagctttgagaagtaactgagaccatgcccgggcctcttcactgctgccaggggctgtggtacctgcagcgtgggggacgtgcttctacaagaacagtcctgagtccacgttctgtttagctttaggaagaaacatctagaagttgtacatattcagagttttccattggcagtgccagtttctagccaatagacttgtctgatcataacattgtaagcctgtagcttgcccagctgctgcctgggcccccattctgctccctcgaggttgctggacaagctgctgcactgtctcagttctgcttgaatacctccatcgatggggaactcacttcctttggaaaaattcttatgtcaagctgaaattctctaattttttctcatcacttccccaggagcagccagaagacaggcagtagttttaatttcaggaacaggtgatccactctgtaaaacagcaggtaaatttcactcaaccccatgtgggaattgatctatatctctacttccagggaccatttgcccttcccaaatccctccaggccagaactgactggagcaggcatggcccaccaggcttcaggagtaggggaagcctggagccccactccagccctgggacaacttgagaattccccctgaggccagttctgtcatggatgctgtcctgagaataacttgctgtcccggtgtcacctgcttccatctcccagcccaccagccctctgcccacctcacatgcctccccatggattggggcctcccaggccccccaccttatgtcaacctgcacttcttgttcaaaaatcaggaaaagaaaagatttgaagaccccaagtcttgtcaataacttgctgtgtggaagcagcgggggaagacctagaaccctttccccagcacttggttttccaacatgatatttatgagtaatttattttgatatgtacatctcttattttcttacattatttatgcccccaaattatatttatgtatgtaagtgaggtttgttttgtatattaaaatggagtttgtttgt

SEQ ID NO: 78 - protein, 216 aa, Homo sapiens
MRSGCVVVHVWILAGLWLAVAGRPLAFSDAGPHVHYGWGDPIRLRHLYTSGPHGLSSCFLRIRADGVVDCARGQSAHSLLEIKAVALRTVAIKGVHSVRYLCMGADGKMQGLLQYSEEDCAFEEEIRPDGYNVYRSEKHRLPVSLSSAKQRQLYKNRGFLPLSHFLPMLPMVPEEPEDLRGHLESDMFSSPLETDSMDPFGLVTGLEAVRSPSFEK

SEQ ID NO: 79 - DNA, 3240 bp, Homo sapiens
cggacgcgtgggcggacgcgtgggcctgggcaagggccggggcgccgggccgagccacctcttcccctcccccgcttccctgtcgcgctccgctggctggacgcgctggaggagtggagcagcacccggccggccctgggggctgacagtcggcaaagtttggcccgaagaggaagtggtctcaaaccccggcaggtggcgaccaggccagaccaggggcgctcgctgcctgcgggcgggctgtaggcgagggcgcgccccagtgccgagacccggggcttcaggagccggccccgggagagaagagtgcggcggcggacggagaaaacaactccaaagttggcgaaaggcaccgcccctactcccgggctgccgccgcctccccgcccccagccctggcatccagagtacgggtcgagcccgggccatggagcccccctggggaggcggcaccagggagcctgggcgcccggggctccgccgcgaccccatcgggtagaccacagaagctccgggacccttccggcacctctggacagcccaggatgctgttggccaccctcctcctcctcctccttggaggcgctctggcccatccagaccggattatttttccaaatcatgcttgtgaggaccccccagcagtgctcttagaagtgcagggcaccttacagaggcccctggtccgggacagccgcacctcccctgccaactgcacctggctcatcctgggcagcaaggaacagactgtcaccatcaggttccagaagctacacctggcctgtggctcagagcgcttaaccctacgctcccctctccagccactgatctccctgtgtgaggcacctcccagccctctgcagctgcccgggggcaacgtcaccatcacttacagctatgctggggccagagcacccatgggccagggcttcctgctctcctacagccaagattggctgatgtgcctgcaggaagagtttcagtgcctgaaccaccgctgtgtatctgctgtccagcgctgtgatggggttgatgcctgtggcgatggctctgatgaagcaggttgcagctcagaccccttccctggcctgaccccaagacccgtcccctccctgccttgcaatgtcaccttggaggacttctatggggtcttctcctctcctggatatacacacctagcctcagtctcccacccccagtcctgccattggctgctggacccccatgatggccggcggctggccgtgcgcttcacagccctggacttgggctttggagatgcagtgcatgtgtatgacggccctgggccccctgagagctcccgactactgcgtagtctcacccacttcagcaatggcaaggctgtcactgtggagacactgtctggccaggctgttgtgtcctaccacacagttgcttggagcaatggtcgtggcttcaatgccacctaccatgtgcggggctattgcttgccttgggacagaccctgtggcttaggctctggcctgggagctggcgaaggcctaggtgagcgctgctacagtgaggcacagcgctgtgacggctcatgggactgtgctgacggcacagatgaggaggactgcccaggctgcccacctggacacttcccctgtggggctgctggcacctctggtgccacagcctgctacctgcctgctgaccgctgcaactaccagactttctgtgctgatggagcagatgagagacgctgtcggcattgccagcctggcaatttccgatgccgggacgagaagtgcgtgtatgagacgtgggtgtgcgatgggcagccagactgtgcggacggcagtgatgagtgggactgctcctatgttctgccccgcaaggtcattacagctgcagtcattggcagcctagtgtgcggcctgctcctggtcatcgccctgggctgcacctgcaagctctatgccattcgcacccaggagtacagcatctttgcccccctctcccggatggaggctgagattgtgcagcagcaggcacccccttcctacgggcagctcattgcccagggtgccatcccacctgtagaagactttcctacagagaatcctaatgataactcagtgctgggcaacctgcgttctctgctacagatcttacgccaggatatgactccaggaggtggcccaggtgcccgccgtcgtcagcggggccgcttgatgcgacgcctggtacgccgtctccgccgctggggcttgctccctcgaaccaacaccccggctcgggcctctgaggccagatcccaggtcacaccttctgctgctccccttgaggccctagatggtggcacaggtccagcccgtgagggcggggcagtgggtgggcaagatggggagcaggcacccccactgcccatcaaggctcccctcccatctgctagcacgtctccagcccccactactgtccctgaagccccagggccactgccctcactgcccctagagccatcactattgtctggagtggtgcaggccctgcgaggccgcctgttgcccagcctggggcccccaggaccaacccggagcccccctggaccccacacagcagtcctggccctggaagatgaggacgatgtgctactggtgccactggctgagccgggggtgtgggtagctgaggcagaggatgagccactgcttacctgaggggacctgggggctctactgaggcctctcccctgggggctctactcatagtggcacaaccttttagaggtgggtcagcctcccctccaccacttccttccctgtccctggatttcagggacttggtgggcctcccgttgaccctatgtagctgctataaagttaagtgtccctcaggcagggagagggctcacagagtctcctctgtacgtggccatggccagacaccccagtcccttcaccaccacctgctccccacgccaccaccatttgggtggctgtttttaaaaagtaaagttcttagaggatcataggtctggacactccatccttgccaaacctctacccaaaagtggccttaagcaccggaatgccaattaactagagaccctccagcccccaaggggaggatttgggcagaacctgaggttttgccatccacaatccctcctacagggcctggctcacaaaaagagtgcaacaaatgcttctattccatagctacggcattgctcagtaagttgaggtcaaaaataaaggaatcatacatctc

SEQ ID NO: 80 - protein, 713 aa, Homo sapiens
MLLATLLLLLLGGALAHPDRIIFPNHACEDPPAVLLEVQGTLQRPLVRDSRTSPANCTWLILGSKEQTVTIRFQKLHLACGSERLTLRSPLQPLISLCEAPPSPLQLPGGNVTITYSYAGARAPMGQGFLLSYSQDWLMCLQEEFQCLNHRCVSAVQRCDGVDACGDGSDEAGCSSDPFPGLTPRPVPSLPCNVTLEDFYGVFSSPGYTHLASVSHPQSCHWLLDPHDGRRLAVRFTALDLGFGDAVHVYDGPGPPESSRLLRSLTHFSNGKAVTVETLSGQAVVSYHTVAWSNGRGFNATYHVRGYCLPWDRPCGLGSGLGAGEGLGERCYSEAQRCDGSWDCADGTDEEDCPGCPPGHFPCGAAGTSGATACYLPADRCNYQTFCADGADERRCRHCQPGNFRCRDEKCVYETWVCDGQPDCADGSDEWDCSYVLPRKVITAAVIGSLVCGLLLVIALGCTCKLYAIRTQEYSIFAPLSRMEAEIVQQQAPPSYGQLIAQGAIPPVEDFPTENPNDNSVLGNLRSLLQILRQDMTPGGGPGARRRQRGRLMRRLVRRLRRWGLLPRTNTPARASEARSQVTPSAAPLEALDGGTGPAREGGAVGGQDGEQAPPLPIKAPLPSASTSPAPTTVPEAPGPLPSLPLEPSLLSGVVQALRGRLLPSLGPPGPTRSPPGPHTAVLALEDEDDVLLVPLAEPGVWVAEAEDEPLLT

SEQ ID NO: 81 - DNA, 4138 bp, Homo sapiens
cttctgtgctgttccttcttgcctctaacttgtaaacaagacgtactaggacgatgctaatggaaagtcacaaaccgctgggtttttgaaaggatccttgggacctcatgcacatttgtggaaactggatggagagatttggggaagcatggactctttagccagcttagttctctgtggagtcagcttgctcctttctggaactgtggaaggtgccatggacttgatcttgatcaattccctacctcttgtatctgatgctgaaacatctctcacctgcattgcctctgggtggcgcccccatgagcccatcaccataggaagggactttgaagccttaatgaaccagcaccaggatccgctggaagttactcaagatgtgaccagagaatgggctaaaaaagttgtttggaagagagaaaaggctagtaagatcaatggtgcttatttctgtgaagggcgagttcgaggagaggcaatcaggatacgaaccatgaagatgcgtcaacaagcttccttcctaccagctactttaactatgactgtggacaagggagataacgtgaacatatctttcaaaaaggtattgattaaagaagaagatgcagtgatttacaaaaatggttccttcatccattcagtgccccggcatgaagtacctgatattctagaagtacacctgcctcatgctcagccccaggatgctggagtgtactcggccaggtatataggaggaaacctcttcacctcggccttcaccaggctgatagtccggagatgtgaagcccagaagtggggacctgaatgcaaccatctctgtactgcttgtatgaacaatggtgtctgccatgaagatactggagaatgcatttgccctcctgggtttatgggaaggacgtgtgagaaggcttgtgaactgcacacgtttggcagaacttgtaaagaaaggtgcagtggacaagagggatgcaagtcttatgtgttctgtctccctgacccctatgggtgttcctgtgccacaggctggaagggtctgcagtgcaatgaagcatgccaccctggtttttacgggccagattgtaagcttaggtgcagctgcaacaatggggagatgtgtgatcgcttccaaggatgtctctgctctccaggatggcaggggctccagtgtgagagagaaggcataccgaggatgaccccaaagatagtggatttgccagatcatatagaagtaaacagtggtaaatttaatcccatttgcaaagcttctggctggccgctacctactaatgaagaaatgaccctggtgaagccggatgggacagtgctccatccaaaagactttaaccatacggatcatttctcagtagccatattcaccatccaccggatcctcccccctgactcaggagtttgggtctgcagtgtgaacacagtggctgggatggtggaaaagcccttcaacatttctgttaaagttcttccaaagcccctgaatgccccaaacgtgattgacactggacataactttgctgtcatcaacatcagctctgagccttactttggggatggaccaatcaaatccaagaagcttctatacaaacccgttaatcactatgaggcttggcaacatattcaagtgacaaatgagattgttacactcaactatttggaacctcggacagaatatgaactctgtgtgcaactggtccgtcgtggagagggtggggaagggcatcctggacctgtgagacgcttcacaacagcttctatcggactccctcctccaagaggtctaaatctcctgcctaaaagtcagaccactctaaatttgacctggcaaccaatatttccaagctcggaagatgacttttatgttgaagtggagagaaggtctgtgcaaaaaagtgatcagcagaatattaaagttccaggcaacttgacttcggtgctacttaacaacttacatcccagggagcagtacgtggtccgagctagagtcaacaccaaggcccagggggaatggagtgaagatctcactgcttggacccttagtgacattcttcctcctcaaccagaaaacatcaagatttccaacattacacactcctcggctgtgatttcttggacaatattggatggctattctatttcttctattactatccgttacaaggttcaaggcaagaatgaagaccagcacgttgatgtgaagataaagaatgccaccatcattcagtatcagctcaagggcctagagcctgaaacagcataccaggtggacatttttgcagagaacaacatagggtcaagcaacccagccttttctcatgaactggtgaccctcccagaatctcaagcaccagcggacctcggaggggggaagatgctgcttatagccatccttggctctgctggaatgacctgcctgactgtgctgttggcctttctgatcatattgcaattgaagagggcaaatgtgcaaaggagaatggcccaagccttccaaaacgtgagggaagaaccagctgtgcagttcaactcagggactctggccctaaacaggaaggtcaaaaacaacccagatcctacaatttatccagtgcttgactggaatgacatcaaatttcaagatgtgattggggagggcaattttggccaagttcttaaggcgcgcatcaagaaggatgggttacggatggatgctgccatcaaaagaatgaaagaatatgcctccaaagatgatcacagggactttgcaggagaactggaagttctttgtaaacttggacaccatccaaacatcatcaatctcttaggagcatgtgaacatcgaggctacttgtacctggccattgagtacgcgccccatggaaaccttctggacttccttcgcaagagccgtgtgctggagacggacccagcatttgccattgccaatagcaccgcgtccacactgtcctcccagcagctccttcacttcgctgccgacgtggcccggggcatggactacttgagccaaaaacagtttatccacagggatctggctgccagaaacattttagttggtgaaaactatgtggcaaaaatagcagattttggattgtcccgaggtcaagaggtgtacgtgaaaaagacaatgggaaggctcccagtgcgctggatggccatcgagtcactgaattacagtgtgtacacaaccaacagtgatgtatggtcctatggtgtgttactatgggagattgttagcttaggaggcacaccctactgcgggatgacttgtgcagaactctacgagaagctgccccagggctacagactggagaagcccctgaactgtgatgatgaggtgtatgatctaatgagacaatgctggcgggagaagccttatgagaggccatcatttgcccagatattggtgtccttaaacagaatgttagaggagcgaaagacctacgtgaataccacgctttatgagaagtttacttatgcaggaattgactgttctgctgaagaagcggcctaggacagaacatctgtataccctctgtttccctttcactggcatgggagacccttgacaactgctgagaaaacatgcctctgccaaaggatgtgatatataagtgtacatatgtgctggaattctaacaagtcataggttaatatttaagacactgaaaaatctaagtgatataaatcagattcttctctctcattttatccctcacctgtagcatgccagtcccgtttcatttagtcatgtgaccactctgtcttgtgtttccacagcctgcaagttcagtccaggatgctaacatctaaaaatagacttaaatctcattgcttacaagcctaagaatctttagagaagtatacataagtttaggataaaataatgggattttcttttcttttctctggtaatattgacttgtatattttaagaaataacagaaagcctgggtgacatttgggagacatgtgacatttatatattgaattaatatccctacatgtattgcacattgtaaaaagttttagttttgatgagttgtgagtttaccttgtatactgtaggcacactttgcactgatatatcatgagtgaataaatgtcttgcctactcaaaaaaaaaaaa

SEQ ID NO: 82 - protein, 1124 aa, Homo sapiens
MDSLASLVLCGVSLLLSGTVEGAMDLILINSLPLVSDAETSLTCIASGWRPHEPITIGRDFEALMNQHQDPLEVTQDVTREWAKKVVWKREKASKINGAYFCEGRVRGEAIRIRTMKMRQQASFLPATLTMTVDKGDNVNISFKKVLIKEEDAVIYKNGSFIHSVPRHEVPDILEVHLPHAQPQDAGVYSARYIGGNLFTSAFTRLIVRRCEAQKWGPECNHLCTACMNNGVCHEDTGECICPPGFMGRTCEKACELHTFGRTCKERCSGQEGCKSYVFCLPDPYGCSCATGWKGLQCNEACHPGFYGPDCKLRCSCNNGEMCDRFQGCLCSPGWQGLQCEREGIPRMTPKIVDLPDHIEVNSGKFNPICKASGWPLPTNEEMTLVKPDGTVLHPKDFNHTDHFSVAIFTIHRILPPDSGVWVCSVNTVAGMVEKPFNISVKVLPKPLNAPNVIDTGHNFAVINISSEPYFGDGPIKSKKLLYKPVNHYEAWQHIQVTNEIVTLNYLEPRTEYELCVQLVRRGEGGEGHPGPVRRFTTASIGLPPPRGLNLLPKSQTTLNLTWQPIFPSSEDDFYVEVERRSVQKSDQQNIKVPGNLTSVLLNNLHPREQYVVRARVNTKAQGEWSEDLTAWTLSDILPPQPENIKISNITHSSAVISWTILDGYSISSITIRYKVQGKNEDQHVDVKIKNATIIQYQLKGLEPETAYQVDIFAENNIGSSNPAFSHELVTLPESQAPADLGGGKMLLIAILGSAGMTCLTVLLAFLIILQLKRANVQRRMAQAFQNVREEPAVQFNSGTLALNRKVKNNPDPTIYPVLDWNDIKFQDVIGEGNFGQVLKARIKKDGLRMDAAIKRMKEYASKDDHRDFAGELEVLCKLGHHPNIINLLGACEHRGYLYLAIEYAPHGNLLDFLRKSRVLETDPAFAIANSTASTLSSQQLLHFAADVARGMDYLSQKQFIHRDLAARNILVGENYVAKIADFGLSRGQEVYVKKTMGRLPVRWMAIESLNYSVYTTNSDVWSYGVLLWEIVSLGGTPYCGMTCAELYEKLPQGYRLEKPLNCDDEVYDLMRQCWREKPYERPSFAQILVSLNRMLEERKTYVNTTLYEKFTYAGIDCSAEEAA

SEQ ID NO: 83 - DNA, 1964 bp, Homo sapiens
cgcgccgggcgcagggagctgagtggacggctcgagacggcggcgcgtgcagcagctccagaaagcagcgagttggcagagcagggctgcatttccagcaggagctgcgagcacagtgctggctcacaacaagatgctcaaggtgtcagccgtactgtgtgtgtgtgcagccgcttggtgcagtcagtctctcgcagctgccgcggcggtggctgcagccggggggcggtcggacggcggtaattttctggatgataaacaatggctcaccacaatctctcagtatgacaaggaagtcggacagtggaacaaattccgagacgaagtagaggatgattatttccgcacttggagtccaggaaaacccttcgatcaggctttagatccagctaaggatccatgcttaaagatgaaatgtagtcgccataaagtatgcattgctcaagattctcagactgcagtctgcattagtcaccggaggcttacacacaggatgaaagaagcaggagtagaccataggcagtggaggggtcccatattatccacctgcaagcagtgcccagtggtctatcccagccctgtttgtggttcagatggtcatacctactcttttcagtgcaaactagaatatcaggcatgtgtcttaggaaaacagatctcagtcaaatgtgaaggacattgcccatgtccttcagataagcccaccagtacaagcagaaatgttaagagagcatgcagtgacctggagttcagggaagtggcaaacagattgcgggactggttcaaggcccttcatgaaagtggaagtcaaaacaagaagacaaaaacattgctgaggcctgagagaagcagattcgataccagcatcttgccaatttgcaaggactcacttggctggatgtttaacagacttgatacaaactatgacctgctattggaccagtcagagctcagaagcatttaccttgataagaatgaacagtgtaccaaggcattcttcaattcttgtgacacatacaaggacagtttaatatctaataatgagtggtgctactgcttccagagacagcaagacccaccttgccagactgagctcagcaatattcagaagcggcaaggggtaaagaagctcctaggacagtatatccccctgtgtgatgaagatggttactacaagccaacacaatgtcatggcagtgttggacagtgctggtgtgttgacagatatggaaatgaagtcatgggatccagaataaatggtgttgcagattgtgctatagattttgagatctccggagattttgctagtggcgattttcatgaatggactgatgatgaggatgatgaagacgatattatgaatgatgaagatgaaattgaagatgatgatgaagatgaaggggatgatgatgatggtggtgatgaccatgatgtatacatttgattgatgacagttgaaatcaataaattctacatttctaatatttacaaaaatgatagcctatttaaaattatcttcttccccaataacaaaatgattctaaacctcacatatattttgtataattatttgaaaaattgcagctaaagttatagaactttatgtttaaataagaatcatttgctttgagtttttatattccttacacaaaaagaaaatacatatgcagtctagtcagacaaaataaagttttgaagtgctactataataaatttttcacgagaacaaactttgtaaatcttccataagcaaaatgacagctagtgcttgggatcgtacatgttaattttttgaaagataattctaagtgaaatttaaaataaataaatttttaatgacctgggtcttaaggatttaggaaaaatatgcatgctttaattgcatttccaaagtagcatcttgctagacctagatgagtcaggataacagagagataccacatgactccaaaaaaaaaaaaaaa

SEQ ID NO: 84 - protein, 436 aa, Homo sapiens
MLKVSAVLCVCAAAWCSQSLAAAAAVAAAGGRSDGGNFLDDKQWLTTISQYDKEVGQWNKFRDEVEDDYFRTWSPGKPFDQALDPAKDPCLKMKCSRHKVCIAQDSQTAVCISHRRLTHRMKEAGVDHRQWRGPILSTCKQCPVVYPSPVCGSDGHTYSFQCKLEYQACVLGKQISVKCEGHCPCPSDKPTSTSRNVKRACSDLEFREVANRLRDWFKALHESGSQNKKTKTLLRPERSRFDTSILPICKDSLGWMFNRLDTNYDLLLDQSELRSIYLDKNEQCTKAFFNSCDTYKDSLISNNEWCYCFQRQQDPPCQTELSNIQKRQGVKKLLGQYIPLCDEDGYYKPTQCHGSVGQCWCVDRYGNEVMGSRINGVADCAIDFEISGDFASGDFHEWTDDEDDEDDIMNDEDEIEDDDEDEGDDDDGGDDHDVYI

SEQ ID NO: 85 - DNA, 1832 bp, Homo sapiens
cccacgcgtccggcactgcagtctccagcctgagccatgggccgccgagccctcctgctcctgcttctgtcttttctggcgccctgggccaccatagccctccggccggccttaagggccctcggcagcctacacttgccaaccaaccccacatccctcccggctgtagccaagaactattcggttctctacttccaacagaaggttgatcattttggatttaatactgtgaaaacttttaatcagcggtacctagtagctgataaatactggaagaaaaatggtggatcaatacttttctacactggtaatgaaggggacattatctggttttgtaataacacggggttcatgtgggatgtggctgaggaactgaaagctatgttggtgtttgctgaacatcgatactatggagagtctctcccctttggtgacaactcattcaaggattccagacacttgaatttcctgacatcagaacaagctctggctgattttgcagagttaatcaaacacttgaaaagaacaatcccaggagctgaaaatcaacctgtcattgccataggaggctcctatggtggcatgcttgccgcctggtttaggatgaaatatcctcatatggtagttggagctcttgcagcttctgcccctatctggcagtttgaggatttagtaccttgtggtgtatttatgaagatcgtaactacagattttaggaaaagcggtccacattgttcagagagcatccacaggtcctgggatgccattaatcgactctcaaatactggcagtggtttgcagtggcttactggagcccttcacttatgcagcccattaacttctcaggacatccaacatttgaaagactggatctctgaaacctgggtgaatctggcaatggtggactatccttatgcctctaactttttacagcctttgcctgcttggcctatcaaggtagtgtgccagtatttgaaaaatcccaatgtatctgattcactgctgctgcagaatattttccaagctctgaatgtatattacaattattcgggccaggtgaaatgcctgaatatttcagagacagcaactagcagtctgggaacactgggttggagctatcaggcctgcacagaagtagtcatgcccttttgtactaatggtgtcgatgacatgtttgaacctcactcatggaacttaaaggaactttctgatgactgttttcaacagtggggtgtgagaccaaggccctcctggatcactactatgtatggaggcaaaaacattagttcacacacaaacattgttttcagcaatggtgaactagacccctggtcaggaggtggagtaactaaggatatcacagacactctggttgcagtcaccatctcagagggggcccaccacttagatctccgcaccaagaatgccttggatcctatgtctgtgctgttagcccgctccttggaagttagacatatgaagaattggatcagagatttctatgacagtgcgggaaagcagcactgagaaacttttgattgttttcaatttcttcttttatgttcacaccaccacattcccattcactttgattttctacatgtaattaccttcttttgtttatcattagatttgatggggccaaagttgagatagaatagagggtgatgacggtaagagcaagtgtcccatgaatgtgatttcctgggttctcactgtcctttgcaccacgtctaggaagaatcttcttgatagctctcccacaccatcagtggccctcataactggagtagagttcctggttgcttttcataagagggagagttactttc

SEQ ID NO: 86 - protein, 496 aa, Homo sapiens
MGRRALLLLLLSFLAPWATIALRPALRALGSLHLPTNPTSLPAVAKNYSVLYFQQKVDHFGFNTVKTFNQRYLVADKYWKKNGGSILFYTGNEGDIIWFCNNTGFMWDVAEELKAMLVFAEHRYYGESLPFGDNSFKDSRHLNFLTSEQALADFAELIKHLKRTIPGAENQPVIAIGGSYGGMLAAWFRMKYPHMVVGALAASAPIWQFEDLVPCGVFMKIVTTDFRKSGPHCSESIHRSWDAINRLSNTGSGLQWLTGALHLCSPLTSQDIQHLKDWISETWVNLAMVDYPYASNFLQPLPAWPIKVVCQYLKNPNVSDSLLLQNIFQALNVYYNYSGQVKCLNISETATSSLGTLGWSYQACTEVVMPFCTNGVDDMFEPHSWNLKELSDDCFQQWGVRPRPSWITTMYGGKNISSHTNIVFSNGELDPWSGGGVTKDITDTLVAVTISEGAHHLDLRTKNALDPMSVLLARSLEVRHMKNWIRDFYDSAGKQH

SEQ ID NO: 87 - DNA, 1894 bp, Homo sapiens
ggcggcgtccgtgaggggctcctttgggcaggggtagtgtttggtgtccctgtcttgcgtgatattgacaaactgaagctttcctgcaccactggacttaaggaagagtgtactcgtaggcggacagctttagtggccggccggccgctctcatcccccgtaaggagcagagtcctttgtactgaccaagatgagcaacatctacatccaggagcctcccacgaatgggaaggttttattgaaaactacagctggagatattgacatagagttgtggtccaaagaagctcctaaagcttgcagaaattttatccaactttgtttggaagcttattatgacaataccatttttcatagagttgtgcctggtttcatagtccaaggcggagatcctactggcacagggagtggtggagagtctatctatggagcgccattcaaagatgaatttcattcacggttgcgttttaatcggagaggactggttgccatggcaaatgctggttctcatgataatggcagccagtttttcttcacactgggtcgagcagatgaacttaacaataagcataccatctttggaaaggttacaggggatacagtatataacatgttgcgactgtcagaagtagacattgatgatgacgaaagaccacataatccacacaaaataaaaagctgtgaggttttgtttaatccttttgatgacatcattccaagggaaattaaaaggctgaaaaaagagaaaccagaggaggaagtaaagaaattgaaacccaaaggcacaaaaaattttagtttactttcatttggagaggaagctgaggaagaagaggaggaagtaaatcgagttagtcagagcatgaagggcaaaagcaaaagtagtcatgacttgcttaaggatgatccacatctcagttctgttccagttgtagaaagtgaaaaaggtgatgcaccagatttagttgatgatggagaagatgaaagtgcagagcatgatgaatatattgatggtgatgaaaagaacctgatgagagaaagaattgccaaaaaattaaaaaaggacacaagtgcgaatgttaaatcagctggagaaggagaagtggagaagaaatcagtcagccgcagtgaagagctcagaaaagaagcaagacaattaaaacgggaactcttagcagcaaaacaaaaaaaagtagaaaatgcagcaaaacaagcagaaaaaagaagtgaagaggaagaagcccctccagatggtgctgttgccgaatacagaagagaaaagcaaaagtatgaagctttgaggaagcaacagtcaaagaagggaacttcccgggaagatcagacccttgcactgctgaaccagtttaaatctaaactcactcaagcaattgctgaaacacctgaaaatgacattcctgaaacagaagtagaagatgatgaaggatggatgtcacatgtacttcagtttgaggataaaagcagaaaagtgaaagatgcaagcatgcaagactcagatacatttgaaatctatgatcctcggaatccagtgaataaaagaaggagggaagaaagcaaaaagctgatgagagagaaaaaagaaagaagataaaatgagaataatgataaccagaacttgctggaaatgtgcctacaatggccttgtaacagccattgttcccaacagcatcacttaggggtgtgaaaagaagtatttttgaacctgttgtctggttttgaaaaacaattatcttgttttgcaaattgtggaatgatgtaagcaaatgcttttggttactggtacatgtgttttttcctagctgaccttttatattgctaaatctgaaataaaataactttccttccacaaaaaaaaaaaaaaaaaaaaaaaaaaaaa

SEQ ID NO: 88 - protein, 472 aa, Homo sapiens
MSNIYIQEPPTNGKVLLKTTAGDIDIELWSKEAPKACRNFIQLCLEAYYDNTIFHRVVPGFIVQGGDPTGTGSGGESIYGAPFKDEFHSRLRFNRRGLVAMANAGSHDNGSQFFFTLGRADELNNKHTIFGKVTGDTVYNMLRLSEVDIDDDERPHNPHKIKSCEVLFNPFDDIIPREIKRLKKEKPEEEVKKLKPKGTKNFSLLSFGEEAEEEEEEVNRVSQSMKGKSKSSHDLLKDDPHLSSVPVVESEKGDAPDLVDDGEDESAEHDEYIDGDEKNLMRERIAKKLKKDTSANVKSAGEGEVEKKSVSRSEELRKEARQLKRELLAAKQKKVENAAKQAEKRSEEEEAPPDGAVAEYRREKQKYEALRKQQSKKGTSREDQTLALLNQFKSKLTQAIAETPENDIPETEVEDDEGWMSHVLQFEDKSRKVKDASMQDSDTFEIYDPRNPVNKRRREESKKLMREKKERR

SEQ ID NO: 89 - DNA, 1196 bp, Homo sapiens
cccggctccgctccctctgccccctcggggtcgcgcgcccacgatgctgcagggccctggctcgctgctgctgctcttcctcgcctcgcactgctgcctgggctcggcgcgcgggctcttcctctttggccagcccgacttctcctacaagcgcagcaattgcaagcccatcccggtcaacctgcagctgtgccacggcatcgaataccagaacatgcggctgcccaacctgctgggccacgagaccatgaaggaggtgctggagcaggccggcgcttggatcccgctggtcatgaagcagtgccacccggacaccaagaagttcctgtgctcgctcttcgcccccgtctgcctcgatgacctagacgagaccatccagccatgccactcgctctgcgtgcaggtgaaggaccgctgcgccccggtcatgtccgccttcggcttcccctggcccgacatgcttgagtgcgaccgtttcccccaggacaacgacctttgcatccccctcgctagcagcgaccacctcctgccagccaccgaggaagctccaaaggtatgtgaagcctgcaaaaataaaaatgatgatgacaacgacataatggaaacgctttgtaaaaatgattttgcactgaaaataaaagtgaaggagataacctacatcaaccgagataccaaaatcatcctggagaccaagagcaagaccatttacaagctgaacggtgtgtccgaaagggacctgaagaaatcggtgctgtggctcaaagacagcttgcagtgcacctgtgaggagatgaacgacatcaacgcgccctatctggtcatgggacagaaacagggtggggagctggtgatcacctcggtgaagcggtggcagaaggggcagagagagttcaagcgcatctcccgcagcatccgcaagctgcagtgctagtcccggcatcctgatggctccgacaggcctgctccagagcacggctgaccatttctgctccgggatctcagctcccgttccccaagcacactcctagctgctccagtctcagcctgggcagcttccccctgccttttgcacgtttgcatccccagcatttcctgagttataaggccacaggagtggatagctgttttcacctaaaggaaaagcccacccgaatcttgtagaaatattcaaactaataaaatcatgaatattttaa

SEQ ID NO: 90 - protein, 295 aa, Homo sapiens [sequence omitted]

SEQ ID NO: 91 - DNA, 3819 bp, Homo sapiens
ggaaggggaggagcaggccacacaggcacaggccggtgagggacctgcccagacctggagggtctcgctctgtcacacaggctggagtgcagtggtgtgatcttggctcatcgtaacctccacctcccgggttcaagtgattctcatgcctcagcctcccgagtagctgggattacaggtggtgacttccaagagtgactccgtcggaggaaaatgactccccagtcgctgctgcagacgacactgttcctgctgagtctgctcttcctggtccaaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactggaaccgacatgctgggagattacatcttctctatggcaagcgtgacttcttgctgagtgacaaagcctctagcctcctctgcttccagcaccaggaggagagcctggctcagggccccccgctgttagccacttctgtcacctcctggtggagccctcagaacatcagcctgcccagtgccgccagcttcaccttctccttccacagtcctccccacacggccgctcacaatgcctcggtggacatgtgcgagctcaaaagggacctccagctgctcagccagttcctgaagcatccccagaaggcctcaaggaggccctcggctgcccccgccagccagcagttgcagagcctggagtcgaaactgacctctgtgagattcatgggggacatggtgtccttcgaggaggaccggatcaacgccacggtgtggaagctccagcccacagccggcctccaggacctgcacatccactcccggcaggaggaggagcagagcgagatcatggagtactcggtgctgctgcctcgaacactcttccagaggacgaaaggccggagcggggaggctgagaagagactcctcctggtggacttcagcagccaagccctgttccaggacaagaattccagccaagtcctgggtgagaaggtcttggggattgtggtacagaacaccaaagtagccaacctcacggagcccgtggtgctcactttccagcaccagctacagccgaagaatgtgactctgcaatgtgtgttctgggttgaagaccccacattgagcagcccggggcattggagcagtgctgggtgtgagaccgtcaggagagaaacccaaacatcctgcttctgcaaccacttgacctactttgcagtgctgatggtctcctcggtggaggtggacgccgtgcacaagcactacctgagcctcctctcctacgtgggctgtgtcgtctctgccctggcctgccttgtcaccattgccgcctacctctgctccagggtgcccctgccgtgcaggaggaaacctcgggactacaccatcaaggtgcacatgaacctgctgctggccgtcttcctgctggacacgagcttcctgctcagcgagccggtggccctgacaggctctgaggctggctgccgagccagtgccatcttcctgcacttctccctgctcacctgcctttcctggatgggcctcgaggggtacaacctctaccgactcgtggtggaggtctttggcacctatgtccctggctacctactcaagctgagcgccatgggctggggcttccccatctttctggtgacgctggtggccctggtggatgtggacaactatggccccatcatcttggctgtgcataggactccagagggcgtcatctacccttccatgtgctggatccgggactccctggtcagctacatcaccaacctgggcctcttcagcctggtgtttctgttcaacatggccatgctagccaccatggtggtgcagatcctgcggctgcgcccccacacccaaaagtggtcacatgtgctgacactgctgggcctcagcctggtccttggcctgccctgggccttgatcttcttctcctttgcttctggcaccttccagcttgtcgtcctctaccttttcagcatcatcacctccttccaaggcttcctcatcttcatctggtactggtccatgcggctgcaggcccggggtggcccctcccctctgaagagcaactcagacagcgccaggctccccatcagctcgggcagcacctcgtccagccgcatctaggcctccagcccacctgcccatgtgatgaagcagagatgcggcctcgtcgcacactgcctgtggcccccgagccaggcccagccccaggccagtcagccgcagactttggaaagcccaacgaccatggagagatgggccgttgccatggtggacggactcccgggctgggcttttgaattggccttggggactactcggctctcactcagctcccacgggactcagaagtgcgccgccatgctgcctagggtactgtccccacatctgtcccaacccagctggaggcctggtctctccttacaacccctgggcccagccctcattgctgggggccaggccttggatcttgagggtctggcacatccttaatcctgtgcccctgcctgggacagaaatgtggctccagttgctctgtctctcgtggtcaccctgagggcactctgcatcctctgtcattttaacctcaggtggcacccagggcgaatggggcccagggcagaccttcagggccagagccctggcggaggagaggccctttgccaggagcacagcagcagctcgcctacctctgagcccaggccccctccctccctcagccccccagtcctccctccatcttccctggggttctcctcctctcccagggcctccttgctccttcgttcacagctgggggtccccgattccaatgctgttttttggggagtggtttccaggagctgcctggtgtctgctgtaaatgtttgtctactgcacaagcctcggcctgcccctgagccaggctcggtaccgatgcgtgggctgggctaggtccctctgtccatctgggcctttgtatgagctgcattgcccttgctcaccctgaccaagcacacgcctcagaggggccctcagcctctcctgaagccctcttgtggcaagaactgtggaccatgccagtcccgtctggtttccatcccaccactccaaggactgagactgacctcctctggtgacactggcctagagcctgacactctcctaagaggttctctccaagcccccaaatagctccaggcgccctcggccgcccatcatggttaattctgtccaacaaacacacacgggtagattgctggcctgttgtaggtggtagggacacagatgaccgacctggtcactcctcctgccaacattcagtctggtatgtgaggcgtgcgtgaagcaagaactcctggagctacagggacagggagccatcattcctgcctgggaatcctggaagacttcctgcaggagtcagcgttcaatcttgaccttgaagatgggaaggatgttctttttacgtaccaattcttttgtcttttgatattaaaaagaagtacatgttcattgtagagaatttggaaactgtagaagagaatcaagaagaaaaataaaaatcagctgttgtaatcgcctagcaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 92 - protein, 693 aa, Homo sapiens
MTPQSLLQTTLFLLSLLFLVQGAHGRGHREDFRFCSQRNQTHRSSLHYKPTPDLRISIENSEEALTVHAPFPAAHPASRSFPDPRGLYHFCLYWNRHAGRLHLLYGKRDFLLSDKASSLLCFQHQEESLAQGPPLLATSVTSWWSPQNISLPSAASFTFSFHSPPHTAAHNASVDMCELKRDLQLLSQFLKHPQKASRRPSAAPASQQLQSLESKLTSVRFMGDMVSFEEDRINATVWKLQPTAGLQDLHIHSRQEEEQSEIMEYSVLLPRTLFQRTKGRSGEAEKRLLLVDFSSQALFQDKNSSQVLGEKVLGIVVQNTKVANLTEPVVLTFQHQLQPKNVTLQCVFWVEDPTLSSPGHWSSAGCETVRRETQTSCFCNHLTYFAVLMVSSVEVDAVHKHYLSLLSYVGCVVSALACLVTIAAYLCSRVPLPCRRKPRDYTIKVHMNLLLAVFLLDTSFLLSEPVALTGSEAGCRASAIFLHFSLLTCLSWMGLEGYNLYRLVVEVFGTYVPGYLLKLSAMGWGFPIFLVTLVALVDVDNYGPIILAVHRTPEGVIYPSMCWIRDSLVSYITNLGLFSLVFLFNMAMLATMVVQILRLRPHTQKWSHVLTLLGLSLVLGLPWALIFFSFASGTFQLVVLYLFSIITSFQGFLIFIWYWSMRLQARGGPSPLKSNSDSARLPISSGSTSSSRI

SEQ ID NO: 93 - DNA, 647 bp, Homo sapiens
cccacgcgtccgaaggcagacaaaggttcatttgtaaagaagctccttccagcacctcctctcttctccttttgcccaaactcacccagtgagtgtgagcatttaagaagcatcctctgccaagaccaaaaggaaagaagaaaaagggccaaaagccaaaatgaaactgatggtacttgttttcaccattgggctaactttgctgctaggagttcaagccatgcctgcaaatcgcctctcttgctacagaaagatactaaaagatcacaactgtcacaaccttccggaaggagtagctgacctgacacagattgatgtcaatgtccaggatcatttctgggatgggaagggatgtgagatgatctgttactgcaacttcagcgaattgctctgctgcccaaaagacgttttctttggaccaaagatctctttcgtgattccttgcaacaatcaatgagaatcttcatgtattctggagaacaccattcctgatttcccacaaactgcactacatcagtataactgcatttctagtttctatatagtgcaatagagcatagattctataaattcttacttgtctaagacaagtaaatctgtgttaaacaagtagtaataaaagttaattcaatctaaaaaaaaaaaaa

SEQ ID NO: 94 - protein, 98 aa, Homo sapiens
MKLMVLVFTIGLTLLLGVQAMPANRLSCYRKILKDHNCHNLPEGVADLTQIDVNVQDHFWDGKGCEMICYCNFSELLCCPKDVFFGPKISFVIPCNNQ

SEQ ID NO: 95 - DNA, 531 bp, Murine
gaattccgggccccaggatgccaactttgaataggatgaagactacaacttgttcccttctcatctgcatctccctgctccagctgatggtcccagtgaatactgatgagaccatagagattatcgtggagaataaggtcaaggaacttcttgccaatccagctaactatccctccactgtaacgaagactctctcttgcactagtgtcaagactatgaacagatgggcctcctgccctgctgggatgactgctactgggtgtgcttgtggctttgcctgtggatcttgggagatccagagtggagatacttgcaactgcctgtgcttactcgttgactggaccactgcccgctgctgccaactgtcctaagaatgaagaggtggagaacccagctttgatatgatgaatctaacaaaaactgcagtctcaatttggaaatctgactcatgtgcctttaaatgtgttcatattgcccatttaccctgcttcttgaaatgcttcttgaaaaataaagacaaatttgcatgtg

SEQ ID NO: 96 - protein, 111 aa, Murine
MKTTTCSLLICISLLQLMVPVNTDETIEIIVENKVKELLANPANYPSTVTKTLSCTSVKTMNRWASCPAGMTATGCACGFACGSWEIQSGDTCNCLCLLVDWTTARCCQLS

SEQ ID NO: 97 - DNA, 1121 bp, Homo sapiens
gaggcagaaaggcagaaaggagaaaattcaggataactctcctgaggggtgagccaagccctgccatgtagtgcacgcaggacatcaacaaacacagataacaggaaatgatccattccctgtggtcacttattctaaaggccccaaccttcaaagttcaagtagtgatatggatgactccacagaaagggagcagtcacgccttacttcttgccttaagaaaagagaagaaatgaaactgaaggagtgtgtttccatcctcccacggaaggaaagcccctctgtccgatcctccaaagacggaaagctgctggctgcaaccttgctgctggcactgctgtcttgctgcctcacggtggtgtctttctaccaggtggccgccctgcaaggggacctggccagcctccgggcagagctgcagggccaccacgcggagaagctgccagcaggagcaggagcccccaaggccggcctggaggaagctccagctgtcaccgcgggactgaaaatctttgaaccaccagctccaggagaaggcaactccagtcagaacagcagaaataagcgtgccgttcagggtccagaagaaacagtcactcaagactgcttgcaactgattgcagacagtgaaacaccaactatacaaaaaggatcttacacatttgttccatggcttctcagctttaaaaggggaagtgccctagaagaaaaagagaataaaatattggtcaaagaaactggttacttttttatatatggtcaggttttatatactgataagacctacgccatgggacatctaattcagaggaagaaggtccatgtctttggggatgaattgagtctggtgactttgtttcgatgtattcaaaatatgcctgaaacactacccaataattcctgctattcagctggcattgcaaaactggaagaaggagatgaactccaacttgcaataccaagagaaaatgcacaaatatcactggatggagatgtcacattttttggtgcattgaaactgctgtgacctacttacaccatgtctgtagctattttcctccctttctctgtacctctaagaagaaagaatctaactgaaaataccaaaaaaaaaaaaaaaa

SEQ ID NO: 98 - protein, 285 aa, Homo sapiens
MDDSTEREQSRLTSCLKKREEMKLKECVSILPRKESPSVRSSKDGKLLAATLLLALLSCCLTVVSFYQVAALQGDLASLRAELQGHHAEKLPAGAGAPKAGLEEAPAVTAGLKIFEPPAPGEGNSSQNSRNKRAVQGPEETVTQDCLQLIADSETPTIQKGSYTFVPWLLSFKRGSALEEKENKILVKETGYFFIYGQVLYTDKTYAMGHLIQRKKVHVFGDELSLVTLFRCIQNMPETLPNNSCYSAGIAKLEEGDELQLAIPRENAQISLDGDVTFFGALKLL

SEQ ID NO: 99 - DNA, 1885 bp, Homo sapiens
gcgaggtggcgatcgctgagaggcaggagggccgaggcgggcctgggaggcggcccggaggtggggcgccgctggggccggcccgcacgggcttcatctgagggcgcacggcccgcgaccgagcgtgcggactggcctcccaagcgtggggcgacaagctgccggagctgcaatgggccgcggctggggattcttgtttggcctcctgggcgccgtgtggctgctcagctcgggccacggagaggagcagcccccggagacagcggcacagaggtgcttctgccaggttagtggttacttggatgattgtacctgtgatgttgaaaccattgatagatttaataactacaggcttttcccaagactacaaaaacttcttgaaagtgactactttaggtattacaaggtaaacctgaagaggccgtgtcctttctggaatgacatcagccagtgtggaagaagggactgtgctgtcaaaccatgtcaatctgatgaagttcctgatggaattaaatctgcgagctacaagtattctgaagaagccaataatctcattgaagaatgtgaacaagctgaacgacttggagcagtggatgaatctctgagtgaggaaacacagaaggctgttcttcagtggaccaagcatgatgattcttcagataacttctgtgaagctgatgacattcagtcccctgaagctgaatatgtagatttgcttcttaatcctgagcgctacactggttacaagggaccagatgcttggaaaatatggaatgtcatctacgaagaaaactgttttaagccacagacaattaaaagacctttaaatcctttggcttctggtcaagggacaagtgaagagaacactttttacagttggctagaaggtctctgtgtagaaaaaagagcattctacagacttatatctggcctacatgcaagcattaatgtgcatttgagtgcaagatatcttttacaagagacctggttagaaaagaaatggggacacaacattacagaatttcaacagcgatttgatggaattttgactgaaggagaaggtccaagaaggcttaagaacttgtattttctctacttaatagaactaagggctttatccaaagtgttaccattcttcgagcgcccagattttcaactctttactggaaataaaattcaggatgaggaaaacaaaatgttacttctggaaatacttcatgaaatcaagtcatttcctttgcattttgatgagaattcattttttgctggggataaaaaagaagcacacaaactaaaggaggactttcgactgcattttagaaatatttcaagaattatggattgtgttggttgttttaaatgtcgtctgtggggaaagcttcagactcagggtttgggcactgctctgaagatcttattttctgagaaattgatagcaaatatgccagaaagtggacctagttatgaattccatctaaccagacaagaaatagtatcattattcaacgcatttggaagaatttctacaagtgtgaaagaattagaaaacttcaggaacttgttacagaatattcattaaagaaaacaagctgatatgtgcctgtttctggacaatggaggcgaaagagtggaatttcattcaaaggcataatagcaatgacagtcttaagccaaacattttatataaagttgcttttgtaaaggagaattatattgttttaagtaaacacatttttaaaaattgtgttaagtctatgtataatactactgtgagtaaaagtaatactttaataatgtggtacaaattttaaagtttaatattgaataaaaggaggattatcaaattaaaaaaaaaaaaaaaaaaaaaaaaaaaaaaaaaaaaaaa

SEQ ID NO: 100 - protein, 468 aa, Homo sapiens
MGRGWGFLFGLLGAVWLLSSGHGEEQPPETAAQRCFCQVSGYLDDCTCDVETIDRFNNYRLFPRLQKLLESDYFRYYKVNLKRPCPFWNDISQCGRRDCAVKPCQSDEVPDGIKSASYKYSEEANNLIEECEQAERLGAVDESLSEETQKAVLQWTKHDDSSDNFCEADDIQSPEAEYVDLLLNPERYTGYKGPDAWKIWNVIYEENCFKPQTIKRPLNPLASGQGTSEENTFYSWLEGLCVEKRAFYRLISGLHASINVHLSARYLLQETWLEKKWGHNITEFQQRFDGILTEGEGPRRLKNLYFLYLIELRALSKVLPFFERPDFQLFTGNKIQDEENKMLLLEILHEIKSFPLHFDENSFFAGDKKEAHKLKEDFRLHFRNISRIMDCVGCFKCRLWGKLQTQGLGTALKILFSEKLIANMPESGPSYEFHLTRQEIVSLFNAFGRISTSVKELENFRNLLQNIH

SEQ ID NO: 101 - DNA, 1615 bp, Homo sapiens
gcctagccaggccaagaatgcaattgccccggtggtgggagctgggagacccctgtgcttggacgggacagggtcgggggacacgcaggatgagccccgcgaccactggcacattcttgctgacagtgtacagtattttctccaaggtacactccgatcggaatgtatacccatcagcaggtgtcctctttgttcatgttttggaaagagaatattttaagggggaatttccaccttacccaaaacctggcgagattagtaatgatcccataacatttaatacaaatttaatgggttacccagaccgacctggatggcttcgatatatccaaaggacaccatatagtgatggagtcctatatgggtccccaacagctgaaaatgtggggaagccaacaatcattgagataactgcctacaacaggcgcacctttgagactgcaaggcataatttgataattaatataatgtctgcagaagacttcccgttgccatatcaagcagaattcttcattaagaatatgaatgtagaagaaatgttggccagtgaggttcttggagactttcttggcgcagtgaaaaatgtgtggcagccagagcgcctgaacgccataaacatcacatcggccctagacaggggtggcagggtgccacttcccattaatgacctgaaggagggcgtttatgtcatggttggtgcagatgtcccgttttcttcttgtttacgagaagttgaaaatccacagaatcaattgagatgtagtcaagaaatggagcctgtaataacatgtgataaaaaatttcgtactcaattttacattgactggtgcaaaatttcattggttgataaaacaaagcaagtgtccacctatcaggaagtgattcgtggagaggggattttacctgatggtggagaatacaaacccccttctgattctttgaaaagcagagactattacacggatttcctaattacactggctgtgccctcggcagtggcactggtcctttttctaatacttgcttatatcatgtgctgccgacgggaaggcgtggaaaagagaaacatgcaaacaccagacatccaactggtccatcacagtgctattcagaaatctaccaaggagcttcgagacatgtccaagaatagagagatagcatggcccctgtcaacgcttcctgtgttccaccctgtgactggggaaatcatacctcctttacacacagacaactatgatagcacaaacatgccattgatgcaaacgcagcagaacttgccacatcagactcagattccccaacagcagactacaggtaaatggtatccctgaagaaagaaaactgactgaagcaatgaatttataatcagacaatatagcagttacatcacatttcttttctcttccaataatgcatgagcttttctggcatatgttatgcatgttggcagtattaagtgtataccaaataatacaacataactttcattttactaatgtatttttttgtacttaaagcatttttgacaatttgtaaaacattgatgactttatatttgttacaataaaagttgatctttaaaataaatattattaatgaagcctaaaaaaaaaaa

SEQ ID NO: 102 - protein, 437 aa, Homo sapiens
MQLPRWWELGDPCAWTGQGRGTRRMSPATTGTFLLTVYSIFSKVHSDRNVYPSAGVLFVHVLEREYFKGEFPPYPKPGEISNDPITFNTNLMGYPDRPGWLRYIQRTPYSDGVLYGSPTAENVGKPTIIEITAYNRRTFETARHNLIINIMSAEDFPLPYQAEFFIKNMNVEEMLASEVLGDFLGAVKNVWQPERLNAINITSALDRGGRVPLPINDLKEGVYVMVGADVPFSSCLREVENPQNQLRCSQEMEPVITCDKKFRTQFYIDWCKISLVDKTKQVSTYQEVIRGEGILPDGGEYKPPSDSLKSRDYYTDFLITLAVPSAVALVLFLILAYIMCCRREGVEKRNMQTPDIQLVHHSAIQKSTKELRDMSKNREIAWPLSTLPVFHPVTGEIIPPLHTDNYDSTNMPLMQTQQNLPHQTQIPQQQTTGKWYP

SEQ ID NO: 103 - DNA, 1621 bp, Homo sapiens
cagaagagggggctagctagctgtctctgcggaccagggagacccccgcgcccccccggtgtgaggcggcctcacagggccgggtgggctggcgagccgacgcggcggcggaggaggctgtgaggagtgtgtggaacaggacccgggacagaggaaccatggctccgcagaacctgagcaccttttgcctgttgctgctatacctcatcggggcggtgattgccggacgagatttctataagatcttgggggtgcctcgaagtgcctctataaaggatattaaaaaggcctataggaaactagccctgcagcttcatcccgaccggaaccctgatgatccacaagcccaggagaaattccaggatctgggtgctgcttatgaggttctgtcagatagtgagaaacggaaacagtacgatacttatggtgaagaaggattaaaagatggtcatcagagctcccatggagacattttttcacacttctttggggattttggtttcatgtttggaggaacccctcgtcagcaagacagaaatattccaagaggaagtgatattattgtagatctagaagtcactttggaagaagtatatgcaggaaattttgtggaagtagttagaaacaaacctgtggcaaggcaggctcctggcaaacggaagtgcaattgtcggcaagagatgcggaccacccagctgggccctgggcgcttccaaatgacccaggaggtggtctgcgacgaatgccctaatgtcaaactagtgaatgaagaacgaacgctggaagtagaaatagagcctggggtgagagacggcatggagtacccctttattggagaaggtgagcctcacgtggatggggagcctggagatttacggttccgaatcaaagttgtcaagcacccaatatttgaaaggagaggagatgatttgtacacaaatgtgacaatctcattagttgagtcactggttggctttgagatggatattactcacttggatggtcacaaggtacatatttcccgggataagatcaccaggccaggagcgaagctatggaagaaaggggaagggctccccaactttgacaacaacaatatcaagggctctttgataatcacttttgatgtggattttccaaaagaacagttaacagaggaagcgagagaaggtatcaaacagctactgaaacaagggtcagtgcagaaggtatacaatggactgcaaggatattgagagtgaataaaattggactttgtttaaaataagtgaataagcgatatttattatctgcaaggtttttttgtgtgtgtttttgtttttattttcaatatgcaagttaggcttaatttttttatctaatgatcatcatgaaatgaataagagggcttaagaatttgtccatttgcattcggaaaagaatgaccagcaaaaggtttactaatacctctccctttggggatttaatgtctggtgctgccgcctgagtttcaagaattaaagctgcaagaggactccaggagcaaaagaaacacaatatagagggttggagttgttagcaatttcattcaaaatgccaactggagaagtctgtttttaaatacattttgttgttattttta

SEQ ID NO: 104 - protein, 358 aa, Homo sapiens
MAPQNLSTFCLLLLYLIGAVIAGRDFYKILGVPRSASIKDIKKAYRKLALQLHPDRNPDDPQAQEKFQDLGAAYEVLSDSEKRKQYDTYGEEGLKDGHQSSHGDIFSHFFGDFGFMFGGTPRQQDRNIPRGSDIIVDLEVTLEEVYAGNFVEVVRNKPVARQAPGKRKCNCRQEMRTTQLGPGRFQMTQEVVCDECPNVKLVNEERTLEVEIEPGVRDGMEYPFIGEGEPHVDGEPGDLRFRIKVVKHPIFERRGDDLYTNVTISLVESLVGFEMDITHLDGHKVHISRDKITRPGAKLWKKGEGLPNFDNNNIKGSLIITFDVDFPKEQLTEEAREGIKQLLKQGSVQKVYNGLQGY

SEQ ID NO: 105 - DNA, 1532 bp, Homo sapiens
ggcacgaggcggcggggcagtcgcgggatgcgcccgggagccacagcctgaggccctcaggtctctgcaggtgtcgtggaggaacctagcacctgccatcctcttccccaatttgccacttccagcagctttagcccatgaggaggatgtgaccgggactgagtcaggagccctctggaagcatggagactgtggtgattgttgccataggtgtgctggccaccatctttctggcttcgtttgcagccttggtgctggtttgcaggcagcgctactgccggccgcgagacctgctgcagcgctatgattctaagcccattgtggacctcattggtgccatggagacccagtctgagccctctgagttagaactggacgatgtcgttatcaccaacccccacattgaggccattctggagaatgaagactggatcgaagatgcctcgggtctcatgtcccactgcattgccatcttgaagatttgtcacactctgacagagaagcttgttgccatgacaatgggctctggggccaagatgaagacttcagccagtgtcagcgacatcattgtggtggccaagcggatcagccccagggtggatgatgttgtgaagtcgatgtaccctccgttggaccccaaactcctggacgcacggacgactgccctgctcctgtctgtcagtcacctggtgctggtgacaaggaatgcctgccatctgacgggaggcctggactggattgaccagtctctgtcggctgctgaggagcatttggaagtccttcgagaagcagccctagcttctgagccagataaaggcctcccaggccctgaaggcttcctgcaggagcagtctgcaatttagtgcctacaggccagcagctagccatgaaggcccctgccgccatccctggatggctcagcttagccttctactttttcctatagagttagttgttctccacggctggagagttcagctgtgtgtgcatagtaaagcaggagatccccgtcagtttatgcctcttttgcagttgcaaactgtggctggtgagtggcagtctaatactacagttaggggagatgccattcactctctgcaagaggagtattgaaaactggtggactgtcagctttatttagctcacctagtgttttcaagaaaattgagccaccgtctaagaaatcaagaggtttcacattaaaattagaatttctggcctctctcgatcggtcagaatgtgtggcaattctgatctgcattttcagaagaggacaatcaattgaaactaagtaggggtttcttcttttggcaagacttgtactctctcacctggcctgtttcatttatttgtattatctgcctggtccctgaggcgtctgggtctctcctctcccttgcaggtttgggtttgaagctgaggaactacaaagttgatgatttcttttttatctttatgcctgcaattttacctagctaccactaggtggatagtaaatttatacttatgtttccctcaaaaaaaaaaaaaaa

SEQ ID NO: 106 - protein, 226 aa, Homo sapiens
METVVIVAIGVLATIFLASFAALVLVCRQRYCRPRDLLQRYDSKPIVDLIGAMETQSEPSELELDDVVITNPHIEAILENEDWIEDASGLMSHCIAILKICHTLTEKLVAMTMGSGAKMKTSASVSDIIVVAKRISPRVDDVVKSMYPPLDPKLLDARTTALLLSVSHLVLVTRNACHLTGGLDWIDQSLSAAEEHLEVLREAALASEPDKGLPGPEGFLQEQSAI

SEQ ID NO: 107 - DNA, 1027 bp, Homo sapiens
  unsure 1017, 1020: unknown base
gcttcatttctcccgactcagcttcccaccctgggctttccgaggtgctttcgccgctgtccccaccactgcagccatgatctccttaacggacacgcagaaaattggaatgggattaacaggatttggagtgtttttcctgttctttggaatgattctcttttttgacaaagcactactggctattggaaatgttttatttgtagccggcttggcttttgtaattggtttagaaagaacattcagattcttcttccaaaaacataaaatgaaagctacaggtttttttctgggtggtgtatttgtagtccttattggttggcctttgataggcatgatcttcgaaatttatggattttttctcttgttcaggggcttctttcctgtcgttgttggctttattagaagagtgccagtccttggatccctcctaaatttacctggaattagatcatttgtagataaagttggagaaagcaacaatatggtataacaacaagtgaatttgaagactcatttaaaatattgtgttatttataaagtcatttgaagaatattcagcacaaaattaaattacatgaaatagcttgtaatgttctttacaggagtttaaaacgtatagcctacaaagtaccagcagcaaattagcaaagaagcagtgaaaacaggcttctactcaagtgaactaagaagaagtcagcaagcaaactgagagaggtgaaatccatgttaatgatgcttaagaaactcttgaaggctatttgtgttgtttttccacaatgtgcgaaactcagccatccttagagaactgtggtgcctgtttcttttctttttattttgaaggctcaggagcatccataggcatttgctttttagaagtgtccactgcaatggcaaaaatatttccagttgcactgtatctctggaagtgatgcatgaattcgattggattgtgtcattttaaagtattaaaaccaaggaaaccccaattttgatgtatggattacttttttttgngcncagggcc

SEQ ID NO: 108 - protein, 138 aa, Homo sapiens
MISLTDTQKIGMGLTGFGVFFLFFGMILFFDKALLAIGNVLFVAGLAFVIGLERTFRFFFQKHKMKATGFFLGGVFVVLIGWPLIGMIFEIYGFFLLFRGFFPVVVGFIRRVPVLGSLLNLPGIRSFVDKVGESNNMV

SEQ ID NO: 109 - DNA, 550 bp, Homo sapiens
ccagtctgtcgccacctcacttggtgtctgctgtccccgccaggcaagcctggggtgagagcacagaggagtgggccgggaccatgcgggggacgcggctggcgctcctggcgctggtgctggctgcctgcggagagctggcgccggccctgcgctgctacgtctgtccggagcccacaggagtgtcggactgtgtcaccatcgccacctgcaccaccaacgaaaccatgtgcaagaccacactctactcccgggagatagtgtaccccttccagggggactccacggtgaccaagtcctgtgccagcaagtgtaagccctcggatgtggatggcatcggccagaccctgcccgtgtcctgctgcaatactgagctgtgcaatgtagacggggcgcccgctctgaacagcctccactgcggggccctcacgctcctcccactcttgagcctccgactgtagagtccccgcccacccccatggccctatgcggcccagccccgaatgccttgaagaagtgccccctgcaccaggaaaaaaaaaaaaaaaaa

SEQ ID NO: 110 - protein, 125 aa, Homo sapiens
MRGTRLALLALVLAACGELAPALRCYVCPEPTGVSDCVTIATCTTNETMCKTTLYSREIVYPFQGDSTVTKSCASKCKPSDVDGIGQTLPVSCCNTELCNVDGAPALNSLHCGALTLLPLLSLRL

SEQ ID NO: 111 - DNA, 2368 bp, Homo sapiens
gcgccgccaggcgtaggcggggtggcccttgcgtctcccgcttccttgaaaaacccggcgggcgagcgaggctgcgggccggccgctgcccttccccacactccccgccgagaagcctcgctcggcgcccaacatggcgggtgggcgctgcggcccgcagctaacggcgctcctggccgcctggatcgcggctgtggcggcgacggcaggccccgaggaggccgcgctgccgccggagcagagccgggtccagcccatgaccgcctccaactggacgctggtgatggagggcgagtggatgctgaaattttacgccccatggtgtccatcctgccagcagactgattcagaatgggaggcttttgcaaagaatggtgaaatacttcagatcagtgtggggaaggtagatgtcattcaagaaccaggtttgagtggccgcttctttgtcaccactctcccagcattttttcatgcaaaggatgggatattccgccgttatcgtggcccaggaatcttcgaagacctgcagaattatatcttagagaagaaatggcaatcagtcgagcctctgactggctggaaatccccagcttctctaacgatgtctggaatggctggtctttttagcatctctggcaagatatggcatcttcacaactatttcacagtgactcttggaattcctgcttggtgttcttatgtgtttttcgtcatagccaccttggtttttggcctttttatgggtctggtcttggtggtaatatcagaatgtttctatgtgccacttccaaggcatttatctgagcgttctgagcagaatcggagatcagaggaggctcatagagctgaacagttgcaggatgcggaggaggaaaaagatgattcaaatgaagaagaaaacaaagacagccttgtagatgatgaagaagagaaagaagatcttggcgatgaggatgaagcagaggaagaagaggaggaggacaacttggctgctggtgtggatgaggagagaagtgaggccaatgatcaggggcccccaggagaggacggtgtgacccgggaggaagtagagcctgaggaggctgaagaaggcatctctgagcaaccctgcccagctgacacagaggtggtggaagactccttgaggcagcgtaaaagtcagcatgctgacaagggactgtagatttaatgatgcgttttcaagaatacacaccaaaacaatatgtcagcttccctttggcctgcagtttgtaccaaatccttaatttttcctgaatgagcaagcttctcttaaaagatgctctctagtcatttggtctcatggcagtaagcctcatgtatactaaggagagtcttccaggtgtgacaatcaggatatagaaaaacaaacgtagtgttgggatctgtttggagactgggatgggaacaagttcatttacttaggggtcagagagtctcgaccagaggaggccattcccagtcctaatcagcaccttccagagacaaggctgcaggccctgtgaaatgaaagccaagcaggagccttggctcctgagcatccccaaagtgtaacgtagaagccttgcatccttttcttgtgtaaagtatttatttttgtcaaattgcaggaaacatcaggcaccacagtgcatgaaaaatctttcacagctagaaattgaaagggccttgggtatagagagcagctcagaagtcatcccagccctctgaatctcctgtgctatgttttatttcttacctttaatttttccagcatttccaccatgggcattcaggctctccacactcttcactattatctcttggtcagaggactccaataacagccaggtttacatgaactgtgtttgttcattctgacctaaggggtttagataatcagtaaccataacccctgaagctgtgactgccaaacatctcaaatgaaatgttgtggccatcagagactcaaaaggaagtaaggattttacaagacagattaaaaaaaaattgttttgtccaaaatatagttgttgttgatttttttttaagttttctaagcaatatttttcaagccagaagtcctctaagtcttgccagtacaaggtagtcttgtgaagaaaagttgaatactgttttgttttcatctcaaggggttccctgggtcttgaactactttaataataactaaaaaaccacttctgattttccttcagtgatgtgcttttggtgaaagaattaatgaactccagtacctgaaagtgaaagatttgattttgtttccatcttctgtaatcttccaaagaattatatctttgtaaatctctcaatactcaatctactgtaagtacccagggaggctaatttcttt

SEQ ID NO: 112 - protein, 349 aa, Homo sapiens
MAGGRCGPQLTALLAAWIAAVAATAGPEEAALPPEQSRVQPMTASNWTLVMEGEWMLKFYAPWCPSCQQTDSEWEAFAKNGEILQISVGKVDVIQEPGLSGRFFVTTLPAFFHAKDGIFRRYRGPGIFEDLQNYILEKKWQSVEPLTGWKSPASLTMSGMAGLFSISGKIWHLHNYFTVTLGIPAWCSYVFFVIATLVFGLFMGLVLVVISECFYVPLPRHLSERSEQNRRSEEAHRAEQLQDAEEEKDDSNEEENKDSLVDDEEEKEDLGDEDEAEEEEEEDNLAAGVDEERSEANDQGPPGEDGVTREEVEPEEAEEGISEQPCPADTEVVEDSLRQRKSQHADKGL

SEQ ID NO: 113 - DNA, 4040 bp, Homo sapiens
gaggaacctaccggtaccggccgcgcgctggtagtcgccggtgtggctgcacctcaccaatcccgtgcgccgcggctgggccgtcggagagtgcgtgtgcttctctcctgcacgcggtgcttgggctcggccaggcggggtccgccgccagggtttgaggatgggggagtagctacaggaagcgaccccgcgatggcaaggtatatttttgtggaatgaaaaggaagtattagaaatgagctgaagaccattcacagattaatatttttggggacagatttgtgatgcttgattcacccttgaagtaatgtagacagaagttctcaaatttgcatattacatcaactggaaccagcagtgaatcttaatgttcacttaaatcagaacttgcataagaaagagaatgggagtctggttaaataaagatgactatatcagagacttgaaaaggatcattctctgttttctgatagtgtatatggccattttagtgggcacagatcaggatttttacagtttacttggagtgtccaaaactgcaagcagtagagaaataagacaagctttcaagaaattggcattgaagttacatcctgataaaaacccgaataacccaaatgcacatggcgattttttaaaaataaatagagcatatgaagtactcaaagatgaagatctacggaaaaagtatgacaaatatggagaaaagggacttgaggataatcaaggtggccagtatgaaagctggaactattatcgttatgattttggtatttatgatgatgatcctgaaatcataacattggaaagaagagaatttgatgctgctgttaattctggagaactgtggtttgtaaatttttactccccaggctgttcacactgccatgatttagctcccacatggagagactttgctaaagaagtggatgggttacttcgaattggagctgttaactgtggtgatgatagaatgctttgccgaatgaaaggagtcaacagctatcccagtctcttcatttttcggtctggaatggccccagtgaaatatcatggagacagatcaaaggagagtttagtgagttttgcaatgcagcatgttagaagtacagtgacagaactttggacaggaaattttgtcaactccatacaaactgcttttgctgctggtattggctggctgatcactttttgttcaaaaggaggagattgtttgacttcacagacacgactcaggcttagtggcatgttgtttctcaactcattggatgctaaagaaatatatttggaagtaatacataatcttccagattttgaactactttcggcaaacacactagaggatcgtttggctcatcatcggtggctgttattttttcattttggaaaaaatgaaaattcaaatgatcctgagctgaaaaaactaaaaactctacttaaaaatgatcatattcaagttggcaggtttgactgttcctctgcaccagacatctgtagtaatctgtatgtttttcagccgtctctagcagtatttaaaggacaaggaaccaaagaatatgaaattcatcatggaaagaagattctatatgatatacttgcctttgccaaagaaagtgtgaattctcatgttaccacgcttggacctcaaaattttcctgccaatgacaaagaaccatggcttgttgatttctttgccccctggtgtccaccatgtcgagctttactaccagagttacgaagagcatcaaatcttctttatggtcagcttaagtttggtacactagattgtacagttcatgagggactctgtaacatgtataacattcaggcttatccaacaacagtggtattcaaccagtccaacattcatgagtatgaaggacatcactctgctgaacaaatcttggagttcatagaggatcttatgaatccttcagtggtctcccttacacccaccaccttcaacgaactagttacacaaagaaaacacaacgaagtctggatggttgatttctattctccgtggtgtcatccttgccaagtcttaatgccagaatggaaaagaatggcccggacattaactggactgatcaacgtgggcagtatagattgccaacagtatcattctttttgtgcccaggaaaacgttcaaagataccctgagataagattttttcccccaaaatcaaataaagcttatcagtatcacagttacaatggttggaatagggatgcttattccctgagaatctggggtctaggatttttacctcaagtatccacagatctaacacctcagactttcagtgaaaaagttctacaagggaaaaatcattgggtgattgatttctatgctccttggtgtggaccttgccagaattttgctccagaatttgagctcttggctaggatgattaaaggaaaagtgaaagctggaaaagtagactgtcaggcttatgctcagacatgccagaaagctgggatcagggcctatccaactgttaagttttatttctacgaaagagcaaagagaaattttcaagaagagcagataaataccagagatgcaaaagcaatcgctgccttaataagtgaaaaattggaaactctccgaaatcaaggcaagaggaataaggatgaactttgataatgttgaagatgaagaaaaagtttaaaagaaattctgacagatgacatcagaagacacctatttagaatgttacatttatgatgggaatgaatgaacattatcttagacttgcagttgtactgccagaattatctacagcactggtgtaaaagaagggtctgcaaactttttctgtaaagggccggtttataaatattttagactttgcaggctataatatatggttcacacatgagaacaagaatagagtcatcatgtattctttgttatttgcttttaacaacctttaaaaaatattaaaacgattcttagctcagagccatacaaaagtaggctggattcagtccatggaccatagattgctgtccccctcgacggacttataatgtttcaggtggctggcttgaacatgagtctgctgtgctatctacataaatgtctaagttgtataaagtccactttcccttcacgttttttggctgacctgaaaagaggtaacttagtttttggtcacttgttctcctaaaaatgctatccctaaccatatatttatatttcgttttaaaaacacccatgatgtggcacagtaaacaaaccctgttatgctgtattattatgaggagattcttcattgttttctttccttctcaaaggttgaaaaaatgcttttaatttttcacagccgagaaacagtgcagcagtatatgtgcacacagtaagtacacaaatttgagcaacagtaagtgcacaaattctgtagtttgctgtatcatccaggaaaacctgagggaaaaaaattatagcaattaactgggcattgtagagtatcctaaatatgttatcaagtatttagagttctatattttaaagatatatgtgttcatgtattttctgaaattgctttcatagaaattttcccactgatagttgatttttgaggcatctaatatttacatatttgccttctgaactttgttttgacctgtatcctttatttacattgggtttttctttcatagttttggtttttcactcctgtccagtctatttattattcaaataggaaaaattactttacaggttgttttactgtagcttataatgatactgtagttattccagttactagtttactgtcagagggctgcctttttcagataaatattgacataataactgaagttatttttataagaaaatcaagtatataaatctaggaaagggatcttctagtttctgtgttgtttagactcaaagaatcacaaatttgtcagtaacatgtagttgtttagttataattcagagtgtacagaatggtaaaaattccaatcagtcaaaagaggtcaatgaattaaaaggcttgcaactttttcaaaaaaaaaaaaaaaaa

SEQ ID NO: 114 - protein, 747 aa, Homo sapiens [sequence omitted]

SEQ ID NO: 115 - DNA, 2720 bp, Homo sapiens
gcgggctgttgacggcgctgcgatggctgcctgcgagggcaggagaagcggagctctcggttcctctcagtcggacttcctgacgccgccagtgggcggggccccttgggccgtcgccaccactgtagtcatgtacccaccgccgccgccgccgcctcatcgggacttcatctcggtgacgctgagctttggcgagagctatgacaacagcaagagttggcggcggcgctcgtgctggaggaaatggaagcaactgtcgagattgcagcggaatatgattctcttcctccttgcctttctgcttttctgtggactcctcttctacatcaacttggctgaccattggaaagctctggctttcaggctagaggaagagcagaagatgaggccagaaattgctgggttaaaaccagcaaatccacccgtcttaccagctcctcagaaggcggacaccgaccctgagaacttacctgagatttcgtcacagaagacacaaagacacatccagcggggaccacctcacctgcagattagacccccaagccaagacctgaaggatgggacccaggaggaggccacaaaaaggcaagaagcccctgtggatccccgcccggaaggagatccgcagaggacagtcatcagctggaggggagcggtgatcgagcctgagcagggcaccgagctcccttcaagaagagcagaagtgcccaccaagcctcccctgccaccggccaggacacagggcacaccagtgcatctgaactatcgccagaagggcgtgattgacgtcttcctgcatgcatggaaaggataccgcaagtttgcatggggccatgacgagctgaagcctgtgtccaggtccttcagtgagtggtttggcctcggtctcacactgatcgacgcgctggacaccatgtggatcttgggtctgaggaaagaatttgaggaagccaggaagtgggtgtcgaagaagttacactttgaaaaggacgtggacgtcaacctgtttgagagcacgatccgcatcctgggggggctcctgagtgcctaccacctgtctggggacagcctcttcctgaggaaagctgaggattttggaaatcggctaatgcctgccttcagaacaccatccaagattccttactcggatgtgaacatcggtactggagttgcccacccgccacggtggacctccgacagcactgtggccgaggtgaccagcattcagctggagttccgggagctctcccgtctcacaggggataagaagtttcaggaggcagtggagaaggtgacacagcacatccacggcctgtctgggaagaaggatgggctggtgcccatgttcatcaatacccacagtggcctcttcacccacctgggcgtattcacgctgggcgccagggccgacagctactatgagtacctgctgaagcagtggatccagggcgggaagcaggagacacagctgctggaagactacgtggaagccatcgagggtgtcagaacgcacctgctgcggcactccgagcccagtaagctcacctttgtgggggagcttgcccacggccgcttcagtgccaagatggaccacctggtgtgcttcctgccagggacgctggctctgggcgtctaccacggcctgcccgccagccacatggagctggcccaggagctcatggagacttgttaccagatgaaccggcagatggagacggggctgagtcccgagatcgtgcacttcaacctttacccccagccgggccgtcgggacgtggaggtcaagccagcagacaggcacaacctgctgcggccagagaccgtggagagcctgttctacctgtaccgcgtcacaggggaccgcaaataccaggactggggctgggagattctgcagagcttcagccgattcacacgggtcccctcgggtggctattcttccatcaacaatgtccaggatcctcagaagcccgagcctagggacaagatggagagcttcttcctgggggagacgctcaagtatctgttcttgctcttctccgatgacccaaacctgctcagcctggacgcctacgtgttcaacaccgaagcccaccctctgcctatctggacccctgcctagggtggatggctgctggtgtggggacttcgggtgggcagaggcaccttgctgggtctgtggcattttccaagggcccacgtagcaccggcaaccgccaagtggcccaggctctgaactggctctgggctcctcctcgtctctgctttaatcaggacaccgtgaggacaagtgaggccgtcagtcttggtgtgatgcggggtgggctgggccgctggagcctccgcctgcttcctccagaagacacgaatcatgactcacgattgctgaagcctgagcaggtctctgtgggccgaccagaggggggcttcgaggtggtccctggtactggggtgaccgagtggacagcccagggtgcagctctgcccgggctcgtgaagcctcagatgtccccaatccaagggtctggaggggctgccgtgactccagaggcctgaggctccagggctggctctggtgtttacaagctggactcagggatcctcctggccgccccgcagggggcttggagggctggacggcaagtccgtctagctcacgggcccctccagtggaatgggtcttttcggtggagataaaagttgatttgctctaaccgcaa

SEQ ID NO: 116 - protein, 699 aa, Homo sapiens
MAACEGRRSGALGSSQSDFLTPPVGGAPWAVATTVVMYPPPPPPPHRDFISVTLSFGESYDNSKSWRRRSCWRKWKQLSRLQRNMILFLLAFLLFCGLLFYINLADHWKALAFRLEEEQKMRPEIAGLKPANPPVLPAPQKADTDPENLPEISSQKTQRHIQRGPPHLQIRPPSQDLKDGTQEEATKRQEAPVDPRPEGDPQRTVISWRGAVIEPEQGTELPSRRAEVPTKPPLPPARTQGTPVHLNYRQKGVIDVFLHAWKGYRKFAWGHDELKPVSRSFSEWFGLGLTLIDALDTMWILGLRKEFEEARKWVSKKLHFEKDVDVNLFESTIRILGGLLSAYHLSGDSLFLRKAEDFGNRLMPAFRTPSKIPYSDVNIGTGVAHPPRWTSDSTVAEVTSIQLEFRELSRLTGDKKFQEAVEKVTQHIHGLSGKKDGLVPMFINTHSGLFTHLGVFTLGARADSYYEYLLKQWIQGGKQETQLLEDYVEAIEGVRTHLLRHSEPSKLTFVGELAHGRFSAKMDHLVCFLPGTLALGVYHGLPASHMELAQELMETCYQMNRQMETGLSPEIVHFNLYPQPGRRDVEVKPADRHNLLRPETVESLFYLYRVTGDRKYQDWGWEILQSFSRFTRVPSGGYSSINNVQDPQKPEPRDKMESFFLGETLKYLFLLFSDDPNLLSLDAYVFNTEAHPLPIWTPA

SEQ ID NO: 117 - DNA, 1621 bp, Homo sapiens
gtgggatttatttgagtgcaagatcgttttctcagtggtggtggaagttgcctcatcgcaggcagatgttggggctttgtccgaacagctcccctctgccagcttctgtagataagggttaaaaactaatatttatatgacagaagaaaaagatgtcattccgtaaagtaaacatcatcatcttggtcctggctgttgctctcttcttactggttttgcaccataacttcctcagcttgagcagtttgttaaggaatgaggttacagattcaggaattgtagggcctcaacctatagactttgtcccaaatgctctccgacatgcagtagatgggagacaagaggagattcctgtggtcatcgctgcatctgaagacaggcttgggggggccattgcagctataaacagcattcagcacaacactcgctccaatgtgattttctacattgttactctcaacaatacagcagaccatctccggtcctggctcaacagtgattccctgaaaagcatcagatacaaaattgtcaattttgaccctaaacttttggaaggaaaagtaaaggaggatcctgaccagggggaatccatgaaacctttaacctttgcaaggttctacttgccaattctggttcccagcgcaaagaaggccatatacatggatgatgatgtaattgtgcaaggtgatattcttgccctttacaatacagcactgaagccaggacatgcagctgcattttcagaagattgtgattcagcctctactaaagttgtcatccgtggagcaggaaaccagtacaattacattggctatcttgactataaaaaggaaagaattcgtaagctttccatgaaagccagcacttgctcatttaatcctggagtttttgttgcaaacctgacggaatggaaacgacagaatataactaaccaactggaaaaatggatgaaactcaatgtagaagagggactgtatagcagaaccctggctggtagcatcacaacacctcctctgcttatcgtattttatcaacagcactctaccatcgatcctatgtggaatgtccgccaccttggttccagtgctggaaaacgatattcacctcagtttgtaaaggctgccaagttactccattggaatggacatttgaagccatggggaaggactgcttcatatactgatgtttgggaaaaatggtatattccagacccaacaggcaaattcaacctaatccgaagatataccgagatctcaaacataaagtgaaacagaatttgaactgtaagcaagcatttctcaggaagtcctggaagatagcatgcatgggaagtaacagttgctaggcttcaatgcctatcggtagcaagccatggaaaaagatgtgtcagctaggtaaagatgacaaactgccctgtctggcagtcagcttcccagacagactatagactataaatatgtctccatctgccttaccaagtgttttcttactacaatgctgaatgactggaaagaagaactgatatggctagttcagctagctggtacagataattcaaaactgctgttggttttaattttgtaacctgtggcctgatctgtaaataaaacttacatttttc

SEQ ID NO: 118 - protein, 371 aa, Homo sapiens
MSFRKVNIIILVLAVALFLLVLHHNFLSLSSLLRNEVTDSGIVGPQPIDFVPNALRHAVDGRQEEIPVVIAASEDRLGGAIAAINSIQHNTRSNVIFYIVTLNNTADHLRSWLNSDSLKSIRYKIVNFDPKLLEGKVKEDPDQGESMKPLTFARFYLPILVPSAKKAIYMDDDVIVQGDILALYNTALKPGHAAAFSEDCDSASTKVVIRGAGNQYNYIGYLDYKKERIRKLSMKASTCSFNPGVFVANLTEWKRQNITNQLEKWMKLNVEEGLYSRTLAGSITTPPLLIVFYQQHSTIDPMWNVRHLGSSAGKRYSPQFVKAAKLLHWNGHLKPWGRTASYTDVWEKWYIPDPTGKFNLIRRYTEISNIK

SEQ ID NO: 119 - DNA, 859 bp, Homo sapiens
ccatccctgagatctttttataaaaaacccagtctttgctgaccagacaaagcataccagatctcaccagagagtcgcagacactatgctgcctcccatggccctgcccagtgtgtcctggatgctgctttcctgcctcattctcctgtgtcaggttcaaggtgaagaaacccagaaggaactgccctctccacggatcagctgtcccaaaggctccaaggcctatggctccccctgctatgccttgtttttgtcaccaaaatcctggatggatgcagatctggcttgccagaagcggccctctggaaaactggtgtctgtgctcagtggggctgagggatccttcgtgtcctccctggtgaggagcattagtaacagctactcatacatctggattgggctccatgaccccacacagggctctgagcctgatggagatggatgggagtggagtagcactgatgtgatgaattactttgcatgggagaaaaatccctccaccatcttaaaccctggccactgtgggagcctgtcaagaagcacaggatttctgaagtggaaagattataactgtgatgcaaagttaccctatgtctgcaagttcaaggactagggcaggtgggaagtcagcagcctcagcttggcgtgcagctcatcatggacatgagaccagtgtgaagactcaccctggaagagaatattctccccaaactgccctacctgactaccttgtcatgatcctccttctttttcctttttcttcaccttcatttcaggcttttctctgtcttccatgtcttgagatctcagagaataataataaaaatgttactttataaaaaaaaaaaaaaaaaaaaaa

SEQ ID NO: 120 - protein, 175 aa, Homo sapiens
MLPPMALPSVSWMLLSCLILLCQVQGEETQKELPSPRISCPKGSKAYGSPCYALFLSPKSWMDADLACQKRPSGKLVSVLSGAEGSFVSSLVRSISNSYSYIWIGLHDPTQGSEPDGDGWEWSSTDVMNYFAWEKNPSTILNPGHCGSLSRSTGFLKWKDYNCDAKLPYVCKFKD

SEQ ID NO: 121 - DNA, 2056 bp, Homo sapiens
aaagttacattttctctggaactctcctaggccactccctgctgatgcaacatctgggtttgggcagaaaggagggtgcttcggagcccgccctttctgagcttcctgggccggctctagaacaattcaggcttcgctgcgactcagacctcagctccaacatatgcattctgaagaaagatggctgagatggacagaatgctttattttggaaagaaacaatgttctaggtcaaactgagtctaccaaatgcagactttcacaatggttctagaagaaatctggacaagtcttttcatgtggtttttctacgcattgattccatgtttgctcacagatgaagtggccattctgcctgcccctcagaacctctctgtactctcaaccaacatgaagcatctcttgatgtggagcccagtgatcgcgcctggagaaacagtgtactattctgtcgaataccagggggagtacgagagcctgtacacgagccacatctggatccccagcagctggtgctcactcactgaaggtcctgagtgtgatgtcactgatgacatcacggccactgtgccatacaaccttcgtgtcagggccacattgggctcacagacctcagcctggagcatcctgaagcatccctttaatagaaactcaaccatccttacccgacctgggatggagatcaccaaagatggcttccacctggttattgagctggaggacctggggccccagtttgagttccttgtggcctactggaggagggagcctggtgccgaggaacatgtcaaaatggtgaggagtgggggtattccagtgcacctagaaaccatggagccaggggctgcatactgtgtgaaggcccagacattcgtgaaggccattgggaggtacagcgccttcagccagacagaatgtgtggaggtgcaaggagaggccattcccctggtactggccctgtttgcctttgttggcttcatgctgatccttgtggtcgtgccactgttcgtctggaaaatgggccggctgctccagtactcctgttgccccgtggtggtcctcccagacaccttgaaaataaccaattcaccccagaagttaatcagctgcagaagggaggaggtggatgcctgtgccacggctgtgatgtctcctgaggaactcctcagggcctggatctcataggtttgcggaagggcccaggtgaagccgagaacctggtctgcatgacatggaaaccatgaggggacaagttgtgtttctgttttccgccacggacaagggatgagagaagtaggaagagcctgttgtctacaagtctagaagcaaccatcagaggcagggtggtttgtctaacagaacactgactgaggcttaggggatgtgacctctagactgggggctgccacttgctggctgagcaaccctgggaaaagtgacttcatcccttcggtcctaagttttctcatctgtaatgggggaattacctacacacctgctaaacacacacacacagagtctctctctatatatacacacgtacacataaatacacccagcacttgcaaggctagagggaaactggtgacactctacagtctgactgattcagtgtttctggagagcaggacataaatgtatgatgagaatgatcaaggactctacacactgggtggcttggagagcccactttcccagaataatccttgagagaaaaggaatcatgggagcaatggtgttgagttcacttcaagcccaatgccggtgcagaggggaatggcttagcgagctctacagtaggtgacctggaggaaggtcacagccacactgaaaatgggatgtgcatgaacacggaggatccatgaactactgtaaagtgttgacagtgtgtgcacactgcagacagcaggtgaaatgtatgtgtgcaatgcgacgagaatgcagaagtcagtaacatgtgcatgtttgttgtgctccttttttctgttggtaaagtacagaattcagcaaataaaaagggccaccctggccaaaagcggtaaaaaaaaaaaaaaaa

SEQ ID NO: 122 - protein, 311 aa, Homo sapiens
MQTFTMVLEEIWTSLFMWFFYALIPCLLTDEVAILPAPQNLSVLSTNMKHLLMWSPVIAPGETVYYSVEYQGEYESLYTSHIWIPSSWCSLTEGPECDVTDDITATVPYNLRVRATLGSQTSAWSILKHPFNRNSTILTRPGMEITKDGFHLVIELEDLGPQFEFLVAYWRREPGAEEHVKMVRSGGIPVHLETMEPGAAYCVKAQTFVKAIGRYSAFSQTECVEVQGEAIPLVLALFAFVGFMLILVVVPLFVWKMGRLLQYSCCPVVVLPDTLKITNSPQKLISCRREEVDACATAVMSPEELLRAWIS

SEQ ID NO: 123 - DNA, 1227 bp, Homo sapiens
cggacgcgtgggccgccacctccggaacaagccatggtggcggcgacggtggcagcggcgtggctgctcctgtgggctgcggcctgcgcgcagcaggagcaggacttctacgacttcaaggcggtcaacatccggggcaaactggtgtcgctggagaagtaccgcggatcggtgtccctggtggtgaatgtggccagcgagtgcggcttcacagaccagcactaccgagccctgcagcagctgcagcgagacctgggcccccaccactttaacgtgctcgccttcccctgcaaccagtttggccaacaggagcctgacagcaacaaggagattgagagctttgcccgccgcacctacagtgtctcattccccatgtttagcaagattgcagtcaccggtactggtgcccatcctgccttcaagtacctggcccagacttctgggaaggagcccacctggaacttctggaagtacctagtagccccagatggaaaggtggtaggggcttgggacccaactgtgtcagtggaggaggtcagaccccagatcacagcgctcgtgaggaagctcatcctactgaagcgagaagacttataaccaccgcgtctcctcctccaccacctcatcccgcccacctgtgtggggctgaccaatgcaaactcaaatggtgcttcaaagggagagacccactgactctccttcctttactcttatgccattggtcccatcattcttgtgggggaaaaattctagtattttgattatttgaatcttacagcaacaaataggaactcctggccaatgagagctcttgaccagtgaatcaccagccgatacgaacgtcttgccaacaaaaatgtgtggcaaatagaagtatatcaagcaataatctcccacccaaggcttctgtaaactgggaccaatgattacctcatagggctgttgtgaggattaggatgaaatacctgtgaaagtgcctaggcagtgccagccaaataggaggcattcaatgaacattttttgcatataaaccaaaaaataacttgttatcaataaaaacttgcatccaacatgaatttccagccgatgataatccaggccaaaggtttagttgttgttatttcctctgtattattttcttcattacaaaagaaatgcaagttcattgtaacaatccaaacaatacctcacgatataaaataaaaatgaaagtatcctcctcaaaaa

SEQ ID NO: 124 - protein, 187 aa, Homo sapiens
MVAATVAAAWLLLWAAACAQQEQDFYDFKAVNIRGKLVSLEKYRGSVSLVVNVASECGFTDQHYRALQQLQRDLGPHHFNVLAFPCNQFGQQEPDSNKEIESFARRTYSVSFPMFSKIAVTGTGAHPAFKYLAQTSGKEPTWNFWKYLVAPDGKVVGAWDPTVSVEEVRPQITALVRKLILLKREDL

SEQ ID NO: 125 - DNA, 1486 bp, Homo sapiens
cggacgcgtgggcggacgcgtgggcggacgcgtgggttgggagggggcaggatgggagggaaagtgaagaaaacagaaaaggagagggacagaggccagaggacttctcatactggacagaaaccgatcaggcatggaactccccttcgtcactcacctgttcttgcccctggtgttcctgacaggtctctgctccccctttaacctggatgaacatcacccacgcctattcccagggccaccagaagctgaatttggatacagtgtcttacaacatgttgggggtggacagcgatggatgctggtgggcgccccctgggatgggccttcaggcgaccggaggggggacgtttatcgctgccctgtagggggggcccacaatgccccatgtgccaagggccacttaggtgactaccaactgggaaattcatctcatcctgctgtgaatatgcacctggggatgtctctgttagagacagatggtgatgggggattcatggtgagctaaggagagggtggtggcagtgtctctgaaggtccataaaagaaaaaagagaagtgtggtaagggaaaatggtctgtgtggaggggtcaaggagttaaaaaccctagaaagcaaaaggtaggtaatgtcagggagtagtcttcatgcctccttcaactgggagcatgttctgagggtgccctcccaagcctgggagtaactatttcccccatccccaggcctgtgcccctctctggtctcgtgcttgtggcagctctgtcttcagttctgggatatgtgcccgtgtggatgcttcattccagcctcagggaagcctggcacccactgcccaacgtgagccagaggaaggctgagtacttggttcccagaaggagatactgggtgggaaaaagatggggcaaagcggtatgatgcctggcaaagggcctgcatggctatcctcattgctacctaatgtgcttgcaaaagctccatgtttcctaacagattcagactcctggccaggtgtggtggcccacacctgtaattctagcactttgggaggccaaggtgggcagatcacttgaggtcaggagttcaagaccagcctggccaacatggtgaaactccatctctactaaaaaaaaaaaaatacaaaaattagctgggtgcgctagtgcatgcctgtaatctcatctactcgggaggctaagacaggagactctcacttcaacccaggaggtggaggttgcggtgagccaagattgtgcctctgcactctagcgtgggtgacagagtaagcgagactccatctcaaaaataataataataataattcagactccttatcaggagtccatgatctggcctggcacagtaactcatgcctgtaatcccaacattttgggaggccaacgcaggaggattgcttgaggtctggaggtttgagaccagcctgggcaacatagaaagaccccatctctaaataaatgttttaaaaat

SEQ ID NO: 126 - protein, 124 aa, Homo sapiens
MELPFVTHLFLPLVFLTGLCSPFNLDEHHPRLFPGPPEAEFGYSVLQHVGGGQRWMLVGAPWDGPSGDRRGDVYRCPVGGAHNAPCAKGHLGDYQLGNSSHPAVNMHLGMSLLETDGDGGFMVS

SEQ ID NO: 127 - DNA, 1523 bp, Homo sapiens
gagaggacgaggtgccgctgcctggagaatcctccgctgccgtcggctcccggagcccagccctttcctaacccaacccaacctagcccagtcccagccgccagcgcctgtccctgtcacggaccccagcgttaccatgcatcctgccgtcttcctatccttacccgacctcagatgctcccttctgctcctggtaacttgggtttttactcctgtaacaactgaaataacaagtcttgctacagagaatatagatgaaattttaaacaatgctgatgttgctttagtaaatttttatgctgactggtgtcgtttcagtcagatgttgcatccaatttttgaggaagcttccgatgtcattaaggaagaatttccaaatgaaaatcaagtagtgtttgccagagttgattgtgatcagcactctgacatagcccagagatacaggataagcaaatacccaaccctcaaattgtttcgtaatgggatgatgatgaagagagaatacaggggtcagcgatcagtgaaagcattggcagattacatcaggcaacaaaaaagtgaccccattcaagaaattcgggacttagcagaaatcaccactcttgatcgcagcaaaagaaatatcattggatattttgagcaaaaggactcggacaactatagagtttttgaacgagtagcgaatattttgcatgatgactgtgcctttctttctgcatttggggatgtttcaaaaccggaaagatatagtggcgacaacataatctacaaaccaccagggcattctgctccggatatggtgtacttgggagctatgacaaattttgatgtgacttacaattggattcaagataaatgtgttcctcttgtccgagaaataacatttgaaaatggagaggaattgacagaagaaggactgccttttctcatactctttcacatgaaagaagatacagaaagtttagaaatattccagaatgaagtagctcggcaattaataagtgaaaaaggtacaataaactttttacatgccgattgtgacaaatttagacatcctcttctgcacatacagaaaactccagcagattgtcctgtaatcgctattgacagctttaggcatatgtatgtgtttggagacttcaaagatgtattaattcctggaaaactcaagcaattcgtatttgacttacattctggaaaactgcacagagaattccatcatggacctgacccaactgatacagccccaggagagcaagcccaagatgtagcaagcagtccacctgagagctccttccagaaactagcacccagtgaatataggtatactctattgagggatcgagatgagctttaaaaacttgaaaaacagtttgtaagcctttcaacagcagcatcaacctacgtggtggaaatagtaaacctatattttcataattctatgtgtatttttattttgaataaacagaaagaaatttaaaaaaaaaaaaaaaaaaaaaaaaaaaaaaaaaaaaaaaaaaaaa

SEQ ID NO: 128 - protein, 406 aa, Homo sapiens [sequence omitted]

SEQ ID NO: 129 - DNA, 1575 bp, Homo sapiens
gagcaggacggagccatggaccccgccaggaaagcaggtgcccaggccatgatctggactgcaggctggctgctgctgctgctgcttcgcggaggagcgcaggccctggagtgctacagctgcgtgcagaaagcagatgacggatgctccccgaacaagatgaagacagtgaagtgcgcgccgggcgtggacgtctgcaccgaggccgtgggggcggtggagaccatccacggacaattctcgctggcagtgcggggttgcggttcgggactccccggcaagaatgaccgcggcctggatcttcacgggcttctggcgttcatccagctgcagcaatgcgctcaggatcgctgcaacgccaagctcaacctcacctcgcgggcgctcgacccggcaggtaatgagagtgcatacccgcccaacggcgtggagtgctacagctgtgtgggcctgagccgggaggcgtgccagggtacatcgccgccggtcgtgagctgctacaacgccagcgatcatgtctacaagggctgcttcgacggcaacgtcaccttgacggcagctaatgtgactgtgtccttgcctgtccggggctgtgtccaggatgaattctgcactcgggatggagtaacaggcccagggttcacgctcagtggctcctgttgccaggggtcccgctgtaactctgacctccgcaacaagacctacttctcccctcgaatcccaccccttgtccggctgccccctccagagcccacgactgtggcctcaaccacatctgtcaccacttctacctcggccccagtgagacccacatccaccaccaaacccatgccagcgccaaccagtcagactccgagacagggagtagaacacgaggcctcccgggatgaggagcccaggttgactggaggcgccgctggccaccaggaccgcagcaattcagggcagtatcctgcaaaaggggggccccagcagccccataataaaggctgtgtggctcccacagctggattggcagcccttctgttggccgtggctgctggtgtcctactgtgagcttctccacctggaaatttccctctcacctacttctctggccctgggtacccctcttctcatcacttcctgttcccaccactggactgggctggcccagcccctgtttttccaacattccccagtatccccagcttctgctgcgctggtttgcggctttgggaaataaaataccgttgtatatattctgccaggggtgttctagctttttgaggacagctcctgtatccttctcatccttgtctctccgcttgtcctcttgtgatgttaggacagagtgagagaagtcagctgtcacggggaaggtgagagagaggatgctaagcttcctactcactttctcctagccagcctggactttggagcgtggggtgggtgggacaatggctccccactctaagcactgcctcccctactccccgcatctttggggaatcggttccccatatgtcttccttactagactgtgagctcctcgagggggggcccggtacccaattcgccctatagtgagtcgta

SEQ ID NO: 130 - protein, 346 aa, Homo sapiens [sequence omitted]

SEQ ID NO: 131 - DNA, 415 bp, Homo sapiens
aaacttgacgccatgaagatcccggtccttcctgccgtggtgctcctctccctcctggtgctccactctgcccagggagccaccctgggtggtcctgaggaagaaagcaccattgagaattatgcgtcacgacccgaggcctttaacaccccgttcctgaacatcgacaaattgcgatctgcgtttaaggctgatgagttcctgaactggcacgccctctttgagtctatcaaaaggaaacttcctttcctcaactgggatgcctttcctaagctgaaaggactgaggagcgcaactcctgatgcccagtgaccatgacctccactggaagagggggctagcgtgagcgctgattctcaacctaccataactctttcctgcctcaggaactccaataaaacattttccatccaaa

SEQ ID NO: 132 - protein, 99 aa, Homo sapiens
MKIPVLPAVVLLSLLVLHSAQGATLGGPEEESTIENYASRPEAFNTPFLNIDKLRSAFKADEFLNWHALFESIKRKLPFLNWDAFPKLKGLRSATPDAQ

SEQ ID NO: 133 - DNA, 678 bp, Homo sapiens
cagttctgaaatcaatggagttaatttagggaatacaaaccagccatgggggtggagattgcctttgcctcagtgattctcacctgcctctcccttctggcagcaggagtctcccaggttgttcttctccagccagttccaactcaggagacaggtcccaaggccatgggagatctctcctgtggctttgccggccactcatgagagtgtttttgtgtaaagtattttttagaatactgttgacttcttcatgatttaataaccatcctttgcgaagttttatgaggctttaggggaatgtcaaccctcaaatttttgttatactagatggcttccatttacccaccactattttaaggtccctttatttttaggttcaaggttcatttgacttgagaaagtgcccttctgcagcttcattgattttgtttatcttcactattaattgtaacgattaaaaaagaataagagcacgcagacctctaggagaatattttatccctgggtgcccctgacacatttatgtagtgatcccacaaatgtgattgttaatttaaatgttattctaatattagtacattcagttgtgatgtaatatgaataaccagaatctatttcttaaaagttttgagtatatttttcaactagatatttgtatagaaagactgaatagtgatg

SEQ ID NO: 134 - protein, 52 aa, Homo sapiens [sequence omitted]

SEQ ID NO: 135 - DNA, 1917 bp, Homo sapiens
ggggaatctgcagtaggtctgccggcgatggagtggtgggctagctcgccgcttcggctctggctgctgttgttcctcctgccctcagcgcagggccgccagaaggagtcaggttcaaaatggaaagtatttattgaccaaattaacaggtctttggagaattacgaaccatgttcaagtcaaaactgcagctgctaccatggtgtcatagaagaggatctaactcctttccgaggaggcatctccaggaagatgatggcagaggtagtcagacggaagctagggacccactatcagatcactaagaacagactgtaccgggaaaatgactgcatgttcccctcaaggtgtagtggtgttgagcactttattttggaagtgatcgggcgtctccctgacatggagatggtgatcaatgtacgagattatcctcaggttcctaaatggatggagcctgccatcccagtcttctccttcagtaagacatcagagtaccatgatatcatgtatcctgcttggacattttgggaagggggacctgctgtttggccaatttatcctacaggtcttggacggtgggacctcttcagagaagatctggtaaggtcagcagcacagtggccatggaaaaagaaaaactctacagcatatttccgaggatcaaggacaagtccagaacgagatcctctcattcttctgtctcggaaaaacccaaaacttgttgatgcagaatacaccaaaaaccaggcctggaaatctatgaaagataccttaggaaagccagctgctaaggatgtccatcttgtggatcactgcaaatacaagtatctgtttaattttcgaggcgtagctgcaagtttccggtttaaacacctcttcctgtgtggctcacttgttttccatgttggtgatgagtggctagaattcttctatccacagctgaagccatgggttcactatatcccagtcaaaacagatctctccaatgtccaagagctgttacaatttgtaaaagcaaatgatgatgtagctcaagagattgctgaaaggggaagccagtttattaggaaccatttgcagatggatgacatcacctgttactgggagaacctcttgagtgaatactctaaattcctgtcttataatgtaacgagaaggaaaggttatgatcaaattattcccaaaatgttgaaaactgaactatagtagtcatcataggaccatagtcctctttgtggcaacagatctcagatatcctacggtgagaagcttaccataagcttggctcctataccttgaatatctgctatcaagccaaatacctggttttccttatcatgctgcacccagagcaactcttgagaaagatttaaaatgtgtctaatacactgatatgaagcagttcaactttttggatgaataaggaccagaaatcgtgagatgtggattttgaacccaactctacctttcattttcttaagaccaatcacagcttgtgcctcagatcatccacctgtgtgagtccatcactgtgaaattgactgtgtccatgtgatgatgccctttgtcccattatttggagcagaaaattcgtcatttggaagtagtacaactcattgctggaattgtgaaattattcaaggcgtgatctctgtcactttattttaatgtaggaaaccctatggggtttatgaaaaatacttggggatcattctctgaatggtctaaggaagcggtagccatgccatgcaatgatgtaggagttctcttttgtaaaaccataaactctgttactcaggaggtttctataatgccacatagaaagaggccaattgcatgagtaattattgcaattggatttcaggttccctttttgtgccttcatgccctacttcttaatgcctctctaaagccaaa

SEQ ID NO: 136 - protein, 392 aa, Homo sapiens
MEWWASSPLRLWLLLFLLPSAQGRQKESGSKWKVFIDQINRSLENYEPCSSQNCSCYHGVIEEDLTPFRGGISRKMMAEVVRRKLGTHYQITKNRLYRENDCMFPSRCSGVEHFILEVIGRLPDMEMVINVRDYPQVPKWMEPAIPVFSFSKTSEYHDIMYPAWTFWEGGPAVWPIYPTGLGRWDLFREDLVRSAAQWPWKKKNSTAYFRGSRTSPERDPLILLSRKNPKLVDAEYTKNQAWKSMKDTLGKPAAKDVHLVDHCKYKYLFNFRGVAASFRFKHLFLCGSLVFHVGDEWLEFFYPQLKPWVHYIPVKTDLSNVQELLQFVKANDDVAQEIAERGSQFIRNHLQMDDITCYWENLLSEYSKFLSYNVTRRKGYDQIIPKMLKTEL

SEQ ID NO: 137 - DNA, 662 bp, Homo sapiens
attctcctagagcatctttggaagcatgaggccacgatgctgcatcttggctcttgtctgctggataacagtcttcctcctccagtgttcaaaaggaactacagacgctcctgttggctcaggactgtggctgtgccagccgacacccaggtgtgggaacaagatctacaacccttcagagcagtgctgttatgatgatgccatcttatccttaaaggagacccgccgctgtggctccacctgcaccttctggccctgctttgagctctgctgtcccgagtcttttggcccccagcagaagtttcttgtgaagttgagggttctgggtatgaagtctcagtgtcacttatctcccatctcccggagctgtaccaggaacaggaggcacgtcctgtacccataaaaaccccaggctccactggcagacggcagacaaggggagaagagacgaagcagctggacatcggagactacagttgaacttcggagagaagcaacttgacttcagagggatggctcaatgacatagctttggagaggagcccagctggggatggccagacttcaggggaagaatgccttcctgcttcatcccctttccagctccccttcccgctgagagccactttcatcggcaataaaatcccccacatttaccatct

SEQ ID NO: 138 - protein, 125 aa, Homo sapiens
MRPRCCILALVCWITVFLLQCSKGTTDAPVGSGLWLCQPTPRCGNKIYNPSEQCCYDDAILSLKETRRCGSTCTFWPCFELCCPESFGPQQKFLVKLRVLGMKSQCHLSPISRSCTRNRRHVLYP

SEQ ID NO: 139 - DNA, 745 bp, Homo sapiens
cctctgtccactgctttcgtgaagacaagatgaagttcacaattgtctttgctggacttcttggagtctttctagctcctgccctagctaactataatatcaacgtcaatgatgacaacaacaatgctggaagtgggcagcagtcagtgagtgtcaacaatgaacacaatgtggccaatgttgacaataacaacggatgggactcctggaattccatctgggattatggaaatggctttgctgcaaccagactctttcaaaagaagacatgcattgtgcacaaaatgaacaaggaagtcatgccctccattcaatcccttgatgcactggtcaaggaaaagaagcttcagggtaagggaccaggaggaccacctcccaagggcctgatgtactcagtcaacccaaacaaagtcgatgacctgagcaagttcggaaaaaacattgcaaacatgtgtcgtgggattccaacatacatggctgaggagatgcaagaggcaagcctgtttttttactcaggaacgtgctacacgaccagtgtactatggattgtggacatttccttctgtggagacacggtggagaactaaacaattttttaaagccactatggatttagtcatctgaatatgctgtgcagaaaaaatatgggctccagtggtttttaccatgtcattctgaaatttttctctactagttatgtttgatttctttaagtttcaataaaatcatttagcattgaaaaaaa

SEQ ID NO: 140 - protein, 185 aa, Homo sapiens
MKFTIVFAGLLGVFLAPALANYNINVNDDNNNAGSGQQSVSVNNEHNVANVDNNNGWDSWNSIWDYGNGFAATRLFQKKTCIVHKMNKEVMPSIQSLDALVKEKKLQGKGPGGPPPKGLMYSVNPNKVDDLSKFGKNIANMCRGIPTYMAEEMQEASLFFYSGTCYTTSVLWIVDISFCGDTVEN

SEQ ID NO: 141 - DNA, 1297 bp, Homo sapiens
ggtccttaatggcagcagccgccgctaccaagatccttctgtgcctcccgcttctgctcctgctgtccggctggtcccgggctgggcgagccgaccctcactctctttgctatgacatcaccgtcatccctaagttcagacctggaccacggtggtgtgcggttcaaggccaggtggatgaaaagacttttcttcactatgactgtggcaacaagacagtcacacctgtcagtcccctggggaagaaactaaatgtcacaacggcctggaaagcacagaacccagtactgagagaggtggtggacatacttacagagcaactgcgtgacattcagctggagaattacacacccaaggaacccctcaccctgcaggcaaggatgtcttgtgagcagaaagctgaaggacacagcagtggatcttggcagttcagtttcgatgggcagatcttcctcctctttgactcagagaagagaatgtggacaacggttcatcctggagccagaaagatgaaagaaaagtgggagaatgacaaggttgtggccatgtccttccattacttctcaatgggagactgtataggatggcttgaggacttcttgatgggcatggacagcaccctggagccaagtgcaggagcaccactcgccatgtcctcaggcacaacccaactcagggccacagccaccaccctcatcctttgctgcctcctcatcatcctcccctgcttcatcctccctggcatctgaggagagtcctttagagtgacaggttaaagctgataccaaaaggctcctgtgagcacggtcttgatcaaactcgcccttctgtctggccagctgcccacgacctacggtgtatgtccagtggcctccagcagatcatgatgacatcatggacccaatagctcattcactgccttgattccttttgccaacaattttaccagcagttatacctaacatattatgcaattttctcttggtgctacctgatggaattcctgcacttaaagttctggctgactaaacaagatatatcattttctttcttctctttttgtttggaaaatcaagtacttctttgaatgatgatctctttcttgcaaatgatattgtcagtaaaataatcacgttagacttcagacctctggggattctttccgtgtcctgaaagagaatttttaaattatttaataagaaaaaatttatattaatgattgtttcctttagtaatttattgttctgtactgatatttaaataaagagttctatttcccaaaaaaaaaaaaaaaaaa

SEQ ID NO: 142 - protein, 246 aa, Homo sapiens
MAAAAATKILLCLPLLLLLSGWSRAGRADPHSLCYDITVIPKFRPGPRWCAVQGQVDEKTFLHYDCGNKTVTPVSPLGKKLNVTTAWKAQNPVLREVVDILTEQLRDIQLENYTPKEPLTLQARMSCEQKAEGHSSGSWQFSFDGQIFLLFDSEKRMWTTVHPGARKMKEKWENDKVVAMSFHYFSMGDCIGWLEDFLMGMDSTLEPSAGAPLAMSSGTTQLRATATTLILCCLLIILPCFILPGI

SEQ ID NO: 143 - DNA, 1869 bp, Homo sapiens
aatgtgagaggggctgatggaagctgataggcaggactggagtgttagcaccagtactggatgtgacagcaggcagaggagcacttagcagcttattcagtgtccgattctgattccggcaaggatccaagcatggaatgctgccgtcgggcaactcctggcacactgctcctctttctggctttcctgctcctgagttccaggaccgcacgctccgaggaggaccgggacggcctatgggatgcctggggcccatggagtgaatgctcacgcacctgcgggggaggggcctcctactctctgaggcgctgcctgagcagcaagagctgtgaaggaagaaatatccgatacagaacatgcagtaatgtggactgcccaccagaagcaggtgatttccgagctcagcaatgctcagctcataatgatgtcaagcaccatggccagttttatgaatggcttcctgtgtctaatgaccctgacaacccatgttcactcaagtgccaagccaaaggaacaaccctggttgttgaactagcacctaaggtcttagatggtacgcgttgctatacagaatctttggatatgtgcatcagtggtttatgccaaattgttggctgcgatcaccagctgggaagcaccgtcaaggaagataactgtggggtctgcaacggagatgggtccacctgccggctggtccgagggcagtataaatcccagctctccgcaaccaaatcggatgatactgtggttgcacttccctatggaagtagacatattcgccttgtcttaaaaggtcctgatcacttatatctggaaaccaaaaccctccaggggactaaaggtgaaaacagtctcagctccacaggaactttccttgtggacaattctagtgtggacttccagaaatttccagacaaagagatactgagaatggctggaccactcacagcagatttcattgtcaagattcgtaactcgggctccgctgacagtacagtccagttcatcttctatcaacccatcatccaccgatggagggagacggatttctttccttgctcagcaacctgtggaggaggttatcagctgacatcggctgagtgctacgatctgaggagcaaccgtgtggttgctgaccaatactgtcactattacccagagaacatcaaacccaaacccaagcttcaggagtgcaacttggatccttgtccagccagtgacggatacaagcagatcatgccttatgacctctaccatccccttcctcggtgggaggccaccccatggaccgcgtgctcctcctcgtgtggggggggcatccagagccgggcagtttcctgtgtggaggaggacatccaggggcatgtcacttcagtggaagagtggaaatgcatgtacacccctaagatgcccatcgcgcagccctgcaacatttttgactgccctaaatggctggcacaggagtggtctccgtgcacagtgacatgtggccagggcctcagataccgtgtggtcctctgcatcgaccatcgaggaatgcacacaggaggctgtagcccaaaaacaaagccccacataaaagaggaatgcatcgtacccactccctgctataaacccaaagagaaacttccagtcgaggccaagttgccatggttcaaacaagctcaagagctagaagaaggagctgctgtgtcagaggagccctcgtaagttgtaaaagcacagactgttctatatttgaaactgttttgtttaaagaaagcagtgtctcactggttgtagctttcatgggttctgaactaagtgtaatcatctcaccaaagctttttggctctcaaattaaagattgattagtttcaaaaaaaaaaa

SEQ ID NO: 144 - protein, 525 aa, Homo sapiens [sequence omitted]

SEQ ID NO: 145 - DNA, 1969 bp, Homo sapiens
ggaggagggagggcgggcaggcgccagcccagagcagccccgggcaccagcacggactctctcttccagcccaggtgccccccactctcgctccattcggcgggagcacccagtcctgtacgccaaggaactggtcctgggggcaccatggtttcggcggcagcccccagcctcctcatccttctgttgctgctgctggggtctgtgcctgctaccgacgcccgctctgtgcccctgaaggccacgttcctggaggatgtggcgggtagtggggaggccgagggctcgtcggcctcctccccgagcctcccgccaccctggaccccggccctcagccccacatcgatggggccccagcccacaaccctggggggcccatcaccccccaccaacttcctggatgggatagtggacttcttccgccagtacgtgatgctgattgctgtggtgggctccctggcctttctgctgatgttcatcgtctgtgccgcggtcatcacccggcagaagcagaaggcctcggcctattacccatcgtccttccccaagaagaagtacgtggaccagagtgaccgggccgggggcccccgggccttcagtgaggtccccgacagagcccccgacagcaggcccgaggaagccctggattcctcccggcagctccaggccgacatcttggccgccacccagaacctcaagtcccccaccagggctgcactgggcggtggggacggagccaggatggtggagggcaggggcgcagaggaagaggagaagggcagccaggagggggaccaggaagtccagggacatggggtcccagtggagacaccagaggcgcaggaggagccgtgctcaggggtccttgagggggctgtggtggccggtgagggccaaggggagctggaagggtctctcttgttagcccaggaagcccagggaccagtgggtccccccgaaagcccctgtgcttgcagcagtgtccaccccagtgtctaacagtcctcccgggctgccagccctgactgtcgggcccccaagtggtcacctccccgtgtatgaaaaggccttcagccctgactgcttcctgacactccctccttggcctccctgtggtgccaatcccagcatgtgctgattctacagcaggcagaaatgctggtccccggtgccccggaggaatcttaccaagtgccatcatccttcacctcagcagccccaaagggctacatcctacagcacagctcccctgacaaagtgagggagggcacgtgtccctgtgacagccaggataaaacatcccccaaagtgctgggattacaggcgtgagccaccgtgcccggcccaaactactttttaaaacagctacagggtaaaatcctgcagcacccactctggaaaatactgctcttaattttcctgaaggtggccccctgtttctagttggtccaggattagggatgtggggtatagggcatttaaatcctctcaagcgctctccaagcacccccggcctgggggtgagtttctcatcccgctactgctgctgggatcaggttgaatgaatggaactcttcctgtctggcctccaaagcagcctagaagctgaggggctgtgtttgaggggacctccaccctggggaagtccgaggggctggggaagggtttctgacgcccagcctggagcaggggggccctggccaccccctgttgctcacacattgtctggcagcctgtgtccacaatattcgtcagtcctcgacagggagcctgggctccgtcctgctttagggaggctctggcaggaggtcctctcccccatccctccatctggggctcccccaacctctgcacagctctccaggtgctgagatataatgcaccagcacaataaacctttattccggcctgaaaaaaaaaaaaaaaaaaaaaaaaaaaaaaaaaaaaaaaaaaaaaaaaaaaaaaaaga

SEQ ID NO: 146 - protein, 283 aa, Homo sapiens
MVSAAAPSLLILLLLLLGSVPATDARSVPLKATFLEDVAGSGEAEGSSASSPSLPPPWTPALSPTSMGPQPTTLGGPSPPTNFLDGIVDFFRQYVMLIAVVGSLAFLLMFIVCAAVITRQKQKASAYYPSSFPKKKYVDQSDRAGGPRAFSEVPDRAPDSRPEEALDSSRQLQADILAATQNLKSPTRAALGGGDGARMVEGRGAEEEEKGSQEGDQEVQGHGVPVETPEAQEEPCSGVLEGAVVAGEGQGELEGSLLLAQEAQGPVGPPESPCACSSVHPSV

SEQ ID NO: 147 - DNA, 860 bp, Homo sapiens
gaaagacgtggtcctgacagacagacaatcctattccctaccaaaatgaagatgctgctgctgctgtgtttgggactgaccctagtctgtgtccatgcagaagaagctagttctacgggaaggaactttaatgtagaaaagattaatggggaatggcatactattatcctggcctctgacaaaagagaaaagatagaagaacatggcaactttagactttttctggagcaaatccatgtcttggagaattccttagttcttaaagtccatactgtaagagatgaagagtgctccgaattatctatggttgctgacaaaacagaaaaggctggtgaatattctgtgacgtatgatggattcaatacatttactatacctaagacagactatgataactttcttatggctcacctcattaacgaaaaggatggggaaaccttccagctgatggggctctatggccgagaaccagatttgagttcagacatcaaggaaaggtttgcacaactatgtgaggagcatggaatccttagagaaaatatcattgacctatccaatgccaatcgctgcctccaggcccgagaatgaagaatggcctgagcctccagtgttgagtggacacttctcaccaggactccaccatcatcccttcctatccatacagcatccccagtataaattctgtgatctgcattccatcctgtctcactgagaagtccaattccagtctatcaacatgttacctaggatacctcatcaagaatcaaagacttctttaaatttctctttgatacacccttgacaatttttcatgaaattattcctcttcctgttcaataaatgattacccttgcacttaa

SEQ ID NO: 148 - protein, 180 aa, Homo sapiens
MKMLLLLCLGLTLVCVHAEEASSTGRNFNVEKINGEWHTIILASDKREKIEEHGNFRLFLEQIHVLENSLVLKVHTVRDEECSELSMVADKTEKAGEYSVTYDGFNTFTIPKTDYDNFLMAHLINEKDGETFQLMGLYGREPDLSSDIKERFAQLCEEHGILRENIIDLSNANRCLQARE

SEQ ID NO: 149 - DNA, 1734 bp, Homo sapiens
gtggactctgagaagcccaggcagttgaggacaggagagagaaggctgcagacccagagggagggaggacagggagtcggaaggaggaggacagaggagggcacagagacgcagagcaagggcggcaaggaggagaccctggtgggaggaagacactctggagagagagggggctgggcagagatgaagttccaggggcccctggcctgcctcctgctggccctctgcctgggcagtggggaggctggccccctgcagagcggagaggaaagcactgggacaaatattggggaggcccttggacatggcctgggagacgccctgagcgaaggggtgggaaaggccattggcaaagaggccggaggggcagctggctctaaagtcagtgaggcccttggccaagggaccagagaagcagttggcactggagtcaggcaggttccaggctttggcgcagcagatgctttgggcaacagggtcggggaagcagcccatgctctgggaaacactgggcacgagattggcagacaggcagaagatgtcattcgacacggagcagatgctgtccgcggctcctggcagggggtgcctggccacagtggtgcttgggaaacttctggaggccatggcatctttggctctcaaggtggccttggaggccagggccagggcaatcctggaggtctggggactccgtgggtccacggataccccggaaactcagcaggcagctttggaatgaatcctcagggagctccctggggtcaaggaggcaatggagggccaccaaactttgggaccaacactcagggagctgtggcccagcctggctatggttcagtgagagccagcaaccagaatgaagggtgcacgaatcccccaccatctggctcaggtggaggctccagcaactctgggggaggcagcggctcacagtcgggcagcagtggcagtggcagcaatggtgacaacaacaatggcagcagcagtggtggcagcagcagtggcagcagcagtggcagcagcagtggcggcagcagtggcggcagcagtggtggcagcagtggcaacagtggtggcagcagaggtgacagcggcagtgagtcctcctggggatccagcaccggctcctcctccggcaaccacggtgggagcggcggaggaaatggacataaacccgggtgtgaaaagccagggaatgaagcccgcgggagcggggaatctgggattcagggcttcagaggacagggagtttccagcaacatgagggaaataagcaaagagggcaatcgcctccttggaggctctggagacaattatcgggggcaagggtcgagctggggcagtggaggaggtgacgctgttggtggagtcaatactgtgaactctgagacgtctcctgggatgtttaactttgacactttctggaagaattttaaatccaagctgggtttcatcaactgggatgccataaacaaggaccagagaagctctcgcatcccgtgacctccagacaaggagccaccagattggatgggagcccccacactccctccttaaaacaccaccctctcatcactaatctcagcccttgcccttgaaataaaccttagctgccccacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 150 - protein, 440 aa, Homo sapiens
MKFQGPLACLLLALCLGSGEAGPLQSGEESTGTNIGEALGHGLGDALSEGVGKAIGKEAGGAAGSKVSEALGQGTREAVGTGVRQVPGFGAADALGNRVGEAAHALGNTGHEIGRQAEDVIRHGADAVRGSWQGVPGHSGAWETSGGHGIFGSQGGLGGQGQGNPGGLGTPWVHGYPGNSAGSFGMNPQGAPWGQGGNGGPPNFGTNTQGAVAQPGYGSVRASNQNEGCTNPPPSGSGGGSSNSGGGSGSQSGSSGSGSNGDNNNGSSSGGSSSGSSSGSSSGGSSGGSSGGSSGNSGGSRGDSGSESSWGSSTGSSSGNHGGSGGGNGHKPGCEKPGNEARGSGESGIQGFRGQGVSSNMREISKEGNRLLGGSGDNYRGQGSSWGSGGGDAVGGVNTVNSETSPGMFNFDTFWKNFKSKLGFINWDAINKDQRSSRIP

SEQ ID NO: 151 - DNA, 1332 bp, Homo sapiens
cggccacagctggcatgctctgcctgatcgccatcctgctgtatgtcctcgtccagtacctcgtgaaccccggggtgctccgcacggaccccagatgtcaagaatatgaacacgtggctgctgttcctccccctgttcccggtgcaggtgcagaccctgatagtcgtgatcatcgggatgctcgtgctcctgctggactttcttggcttggtgcacctgggccagctgctcatcttccacatctacctgagtatgtcccccaccctaagcccccgatccccccaaggctgggtggtcagagctgctcatcttacacctctacttgagtatgtccctaaccctgagccccccacgcctggggccagagtctttgtcccccgtgtgcgcatgtgttcagggtcagcctctcccagaagtgagatcatggacaaaaagggcaaatcacaggaagaaattaaatccatgaggacccagcaggcccagcaagaagctgaactcacgccgagacctgcaggagtggtgccaggtgcttgaagtaacaagtttaaaatgttcagagacaatggaatggaatctattaggcaagaacaggacattatgaaataaggacaggtggacttccaaaaacacaagtagaaattctaacaatgaaatatattacaggcaggtcacccactaaccaaacaactgaagcgagagctgtggtcttgcttggtctcacagtgggcacagcggtaggcggtcagtcatgttgctgaacgacggagggtaaactccccagccccaagaaaacctgtgttggaagtaacaacaacctccctgctcctggcaccagccgttttggtcatggtgggccagctgcaaagcgtcttccattctctgggcagtggtggccccgaggctgtggcctctcagggggtttctgtggacacgggcagcagagtgtgtccaggccagcccccaagaatgccctgctcctgacagcttggccaacccctggtcagggcagagggagttgggtgggtcaggctctgggctcacctccatctccagagcatcccctgcctgcagttgtggcaagaacgcccagctcagaatgaacacaccccaccaagagcctccttgttcataaccacaggttaccctacaaaccactgtccccacacaaccctggggatgttttaaaacacacacctctaacgcatatcttacagtcactgttgtcttgcctgagggttgaattttttttaatgaaagtgcaatgaaaatcactggattaaatcctacggacacagagctgaaaaaaaaaaaaaaaaaaaaaaaaaaaaaaaa

SEQ ID NO: 152 - protein, 142 aa, Homo sapiens
MNTWLLFLPLFPVQVQTLIVVIIGMLVLLLDFLGLVHLGQLLIFHIYLSMSPTLSPRSPQGWVVRAAHLTPLLEYVPNPEPPTPGARVFVPRVRMCSGSASPRSEIMDKKGKSQEEIKSMRTQQAQQEAELTPRPAGVVPGA

SEQ ID NO: 153 - DNA, 1158 bp, Homo sapiens
aactggaaggaaagaaagaaaggtcagctttggcccagatgtggttaccccttggtctcctgtctttatgtctttctcctcttcctattctgtcatctccctcacttaagtctcaggcctgtcagcagctcctgtggacattgccatcccctctggtagccttcagagcaaacaggacaacctatgttatggatgtttccaccaaccagggtagtggcatggagcaccgtaaccatctgtgcttctgtgatctctatgacagagccacttctccacctctgaaatgttccctgctctgaaatctggcatgagatggcacaggtgaccacgcagaagccaccagaatcttgcctgccctattcctcctcccaagtctgttctcttattgtcaacctcagcacaacaggctggcgccaatggcattacagagaaagcaatctgtgtggctagtgggcagattaccatgcaagccccaggagaaatggaggagctttgtagccacctccctgtcagccagtattaacatgtccccttccccctgccccgccgtagattcaggacattcgcccctgtgtgccaccaaaccaggactttccccttggcttggcatccctggctctctcctggtacccagcaagacgtctgttccagggcagtgtagcatctttcaagctccgttactatggcgatggccatgatgttacaatcccacttgcctgaataatcaagtgggaaggggaagcagagggaaatggggccatgtgaatgcagctgctctgttctccctaccctgaggaaaaaccaaagggaagcaacaggaacttctgcaactggtttttatcggaaagatcatcctgcctgcagatgctgttgaaggggcacaagaaatgtagctggagaagattgatgaaagtgcaggtgtgtaaggaaatagaacagtctgctgggagtcagacctggaattctgattccaaactctttattactttgggaagtcactcagcctccccgtagccatctccagggtgacggaacccagtgtattacctgctggaaccaaggaaactaacaatgtaggttactagtgaataccccaatggtttctccaattatgcccatgccaccaaaacaataaaacaaaattctctaacactgaaa

SEQ ID NO: 154 - protein, 86 aa, Homo sapiens
MWLPLGLLSLCLSPLPILSSPSLKSQACQQLLWTLPSPLVAFRANRTTYVMDVSTNQGSGMEHRNHLCFCDLYDRATSPPLKCSLL

SEQ ID NO: 155 - DNA, 2694 bp, Homo sapiens
gtagcgcgtcttgggtctcccggctgccgctgctgccgccgccgcctcgggtcgtggagccaggagcgacgtcaccgccatggcaggcatcaaagctttgattagtttgtcctttggaggagcaatcggactgatgtttttgatgcttggatgtgcccttccaatatacaacaaatactggcccctctttgttctatttttttacatcctttcacctattccatactgcatagcaagaagattagtggatgatacagatgctatgagtaacgcttgtaaggaacttgccatctttcttacaacgggcattgtcgtgtcagcttttggactccctattgtatttgccagagcacatctgattgagtggggagcttgtgcacttgttctcacaggaaacacagtcatctttgcaactatactaggctttttcttggtctttggaagcaatgacgacttcagctggcagcagtggtgaaaagaaattactgaactattgtcaaatggacttcctgtcatttgttggccattcacgcacacaggagatggggcagttaatgctgaatggtatagcaagcctcttgggggtattttaggtgctcccttctcacttttattgtaagcatactattttcacagagacttgctgaaggattaaaaggattttctcttttggaaaagcttgactgatttcacacttatctatagtatgctttttgtggtgtcctgctgaatttaaatatttatgtgtttttcctgttaggttgattttttttggaatcaatatgcaatgttaaacacttttttaatgtaatcatttgcattggttaggaattcagaattccgccggctctattactggtcaagtacatcttttctcttaaaattatttagcctccattattacaaaaaattataaaaataagttttcagtcagtcaggatgacatcactcccaatgttatgcagacatacagacggttggcatacgttatagactgtatactcagtgcaaatatagctgcatttatacctcagaggggccaagtgttaatgcccatgccctccgttaagggttgttggttttactggtagacagatgttttgtggattgaaaattattttatggaattgctacagaggagtgcttttcttctcaattgttagaagaatttatgttaaactttaaggtaagggtgtaaaaacatttttgagataaggtttttatttatgtttattattgttagagtgagttgcaatgtgggaagaaatgacattgaaattccagtttttgaatcctgtttctatttataagtgaaatttgtgatctcctatcaacctttcatgttttaccctgttaaaatggacatacatggaaccactactgatgagggacagttgtatgtttgcatcatatatgccagaaaaccttcctctgcttcctccttttgacttatttggtatgttgtatatattacataaaataacttttcaaatatagtttaataacacttagaagtgtttacttacctggaaaataattgctatgccgtacattcagagtgccccctcccctgcaaggccttgccatgattaacaagtaacttgttagtcttacagataattcatgcattaacagtttaagatttagaccatggtaatagtagttcttattctctaaggttatatcatatgtaatttaaaagtatttttaagacaagtttcctgtatacctctgaactgttttgattttgagttcatcatgatagatctgctgtttccttataaaaggcatttgttgtgtgagttaatgcaaagtagccaagtccagctatatagcagcttcagaaacatacctgaccaaaaaattcccagtaaccaggcatgatcaatttatagtggtcgtttacatctaataattatcaggacttttttcaggagtgggttataaaaacattcaagttggtctgacagtattttgttaaggatatttgtttgtatgtttattcagtatacttacataaaaattatttcgccatcagccaaaactcagtaatcatgacagctgtctgttgttttatgaagtttatttctcaagaaaatgggaataaatttgggatttgttcagcttttttactaaagatgcctaaagccacaggttttattgcctaacttaagccatgacttttagatatgagatgacgggaagcaggacgaaatatcggcgtgtggctggagccttcccactggaggctgaaagtggcttgtggtattataatgttcagatttcaagaggaaggtgcaggtacacatgagttagagagctggtgagacagttgggaactctttgtgcttgtgatctactggactttttttttgcaggaagtgcattctctggtccttccctattttctgttctggatgtcagtgcagtgcactgctactgttttatccacttggccacagactttttctaacagctgcgtattatttctatatactaattgcattggcagcattgtgtctttgaccttgtatactagcttgacatagtgctgtctctgatttctaggctagttacttgagatatgaattttccatagaatatgcactgatacaacattaccattcttctatggaaagaaaacttttgatgatgaaacaataaagattttaaatatctattttaaaaaaaaaa

SEQ ID NO: 156 - protein, 131 aa, Homo sapiens
MAGIKALISLSFGGAIGLMFLMLGCALPIYNKYWPLFVLFFYILSPIPYCIARRLVDDTDAMSNACKELAIFLTTGIVVSAFGLPIVFARAHLIEWGACALVLTGNTVIFATILGFFLVFGSNDDFSWQQW

SEQ ID NO: 157 - DNA, 4277 bp, Homo sapiens
gtttctcatagttggcgtcttctaaaggaaaaacactaaaatgaggaactcagcggaccgggagcgacgcagcttgagggaagcatccctagctgttggcgcagaggggcgaggctgaagccgagtggcccgaggtgtctgaggggctggggcaaaggtgaaagagtttcagaacaagcttcctggaacccatgacccatgaagtcttgtcgacatttataccgtctgagggtagcagctcgaaactagaagaagtggagtgttgccagggacggcagtatctctttgtgtgaccctggcggcctatgggacgttggcttcagacctttgtgatacaccatgctgcgtgggacgatgacggcgtggagaggaatgaggcctgaggtcacactggcttgcctcctcctagccacagcaggctgctttgctgacttgaacgaggtccctcaggtcaccgtccagcctgcgtccaccgtccagaagcccggaggcactgtgatcttgggctgcgtggtggaacctccaaggatgaatgtaacctggcgcctgaatggaaaggagctgaatggctcggatgatgctctgggtgtcctcatcacccacgggaccctcgtcatcactgcccttaacaaccacactgtgggacggtaccagtgtgtggcccggatgcctgcgggggctgtggccagcgtgccagccactgtgacactagccaatctccaggacttcaagttagatgtgcagcacgtgattgaagtggatgagggaaacacagcagtcattgcctgccacctgcctgagagccaccccaaagcccaggtccggtacagcgtcaaacaagagtggctggaggcctccagaggtaactacctgatcatgccctcagggaacctccagattgtgaatgccagccaggaggacgagggcatgtacaagtgtgcagcctacaacccagtgacccaggaagtgaaaacctccggctccagcgacaggctacgtgtgcgccgctccaccgctgaggctgcccgcatcatctaccccccagaggcccaaaccatcatcgtcaccaaaggccagagtctcattctggagtgtgtggccagtggaatcccacccccacgggtcacctgggccaaggatgggtccagtgtcaccggctacaacaagacgcgcttcctgctgagcaacctcctcatcgacaccaccagcgaggaggactcaggcacctaccgctgcatggccgacaatggggttgggcagcccggggcagcggtcatcctctacaatgtccaggtgtttgaaccccctgaggtcaccatggagctatcccagctggtcatcccctggggccagagtgccaagcttacctgtgaggtgcgtgggaaccccccgccctccgtgctgtggctgaggaatgctgtgcccctcatctccagccagcgcctccggctctcccgcagggccctgcgcgtgctcagcatggggcctgaggacgaaggcgtctaccagtgcatggccgagaacgaggttgggagcgcccatgccgtagtccagctgcggacctccaggccaagcataaccccaaggctatggcaggatgctgagctggctactggcacacctcctgtatcaccctccaaactcggcaaccctgagcagatgctgagggggcaaccggcgctccccagacccccaacgtcagtggggcctgcttccccgaagtgtccaggagagaaggggcagggggctcccgccgaggctcccatcatcctcagctcgccccgcacctccaagacagactcatatgaactggtgtggcggcctcggcatgagggcagtggccgggcgccaatcctctactatgtggtgaaacaccgcaagcaggtcacaaattcctctgacgattggaccatctctggcattccagccaaccagcaccgcctgaccctcaccagacttgaccccgggagcttgtatgaagtggagatggcagcttacaactgtgcgggagagggccagacagccatggtcaccttccgaactggacggcggcccaaacccgagatcatggccagcaaagagcagcagatccagagagacgaccctggagccagtccccagagcagcagccagccagaccacggccgcctctcccccccagaagctcccgacaggcccaccatctccacggcctccgagacctcagtgtacgtgacctggattccccgtgggaatggtgggttcccaatccagtccttccgtgtggagtacaagaagctaaagaaagtgggagactggattctggccaccagcgccatccccccatcgcggctgtccgtggagatcacgggcctagagaaaggcacctcctacaagtttcgagtccgggctctgaacatgctgggggagagcgagcccagcgccccctctcggccctacgtggtgtcgggctacagcggtcgcgtgtacgagaggcccgtggcaggtccttatatcaccttcacggatgcggtcaatgagaccaccatcatgctcaagtggatgtacatcccagcaagtaacaacaacaccccaatccatggcttttatatctattatcgacccacagacagtgacaatgatagtgactacaagaaggatatggtggaaggggacaagtactggcactccatcagccacctgcagccagagacctcctacgacattaagatgcagtgcttcaatgaaggaggggagagcgagttcagcaacgtgatgatctgtgagaccaaagctcggaagtcttctggccagcctggtcgactgccacccccaactctggccccaccacagccgccccttcctgaaaccatagagcggccggtgggcactggggccatggtggctcgctccagcgacctgccctatctgattgtcggggtcgtcctgggctccatcgttctcatcatcgtcaccttcatccccttctgcttgtggagggcctggtctaagcaaaaacatacaacagacctgggttttcctcgaagtgcccttccaccctcctgcccgtatactatggtgccattgggaggactcccaggccaccaggccagtggacagccctacctcagtggcatcagtggacgggcctgtgctaatgggatccacatgaataggggctgcccctcggctgcagtgggctacccgggcatgaagccccagcagcactgcccaggcgagcttcagcagcagagtgacaccagcagcctgctgaggcagacccatcttggcaatggatatgacccccaaagtcaccagatcacgaggggtcccaagtctagcccggacgagggctctttcttatacacactgcccgacgactccactcaccagctgctgcagccccatcacgactgctgccaacgccaggagcagcctgctgctgtgggccagtcaggggtgaggagagcccccgacagtcctgtcctggaagcagtgtgggaccctccatttcactcagggcccccatgctgcttgggccttgtgccagttgaagaggtggacagtcctgactcctgccaagtgagtggaggagactggtgtccccagcaccccgtaggggcctacgtaggacaggaacctggaatgcagctctccccggggccactggtgcgtgtgtcttttgaaacaccacctctcacaatttaggcagaagctgatatcccagaaagactatatattgttttttttttaaaaaaaaaagaagaaaaaagagacagagaaaattggtatttatttttctattatagccatatttatatatttatgcacttgtaaataaatgtatatgttttataattctggagagacataaggagtcctacccgttgaggttggagagggaaaataaagaagctgccacctaacaggagtcacccaggaaagcaccgcacaggctggcgcgggacagactcctaacctggggcctctgcagtggcaggcgaggctgcaggaggcccacagataagctggcaagaggaaggatcccaggcacatggttcatcacgagcatgagggaacagcaaggggcacggtatcacagcctggagacacccacacagatggctggatccggtgctacgggaaacattttcctaagatgcccatgagaacagaccaagatgtgtacagcactatgagcattaaaaaaccttccagaatcaataatccgtggcaacatatctctgtaaaaacaaacactgtaacttctaaataaatgtttagtcttccctgtaaaa

SEQ ID NO: 158 - protein, 1115 aa, Homo sapiens [sequence omitted]

SEQ ID NO: 159 - DNA, 4104 bp, Homo sapiens
cccacgcgtccgcccacgcgtccgcccacgcgtccgcccacgcgtccgcccacgcgtccgcccacgcgtccgcccacgcgtccggtgcaagctcgcgccgcacactgcctggtggagggaaggagcccgggcgcctctcgccgctccccgcgccgccgtccgcacctccccaccgcccgccgcccgccgcccgccgcccgcaaagcatgagtgagcccgctctctgcagctgcccggggcgcgaatggcaggctgtttccgcggagtaaaaggtggcgccggtcagtggtcgtttccaatgacggacattaaccagactgtcagatcctggggagtcgcgagccccgagtttggagttttttccccccacaacgtcacagtccgaactgcagagggaaaggaaggcggcaggaaggcgaagctcgggctccggcacgtagttgggaaacttgcgggtcctagaagtcgcctccccgccttgccggccgcccttgcagccccgagccgagcagcaaagtgagacattgtgcgcctgccagatccgccggccgcggaccggggctgcctcggaaacacagaggggtcttctctcgccctgcatataattagcctgcacacaaagggagcagctgaatggaggttgtcactctctggaaaaggatttctgaccgagcgcttccaatggacattctccagtctctctggaaagattctcgctaatggatttcctgctgctcggtctctgtctatactggctgctgaggaggccctcgggggtggtcttgtgtctgctgggggcctgctttcagatgctgcccgccgcccccagcgggtgcccgcagctgtgccggtgcgaggggcggctgctgtactgcgaggcgctcaacctcaccgaggcgccccacaacctgtccggcctgctgggcttgtccctgcgctacaacagcctctcggagctgcgcgccggccagttcacggggttaatgcagctcacgtggctctatctggatcacaatcacatctgctccgtgcagggggacgcctttcagaaactgcgccgagttaaggaactcacgctgagttccaaccagatcacccaactgcccaacaccaccttccggcccatgcccaacctgcgcagcgtggacctctcgtacaacaagctgcaggcgctcgcgcccgacctcttccacgggctgcggaagctcaccacgctgcatatgcgggccaacgccatccagtttgtgcccgtgcgcatcttccaggactgccgcagcctcaagtttctcgacatcggatacaatcagctcaagagtctggcgcgcaactctttcgccggcttgtttaagctcaccgagctgcacctcgagcacaacgacttggtcaaggtgaacttcgcccacttcccgcgcctcatctccctgcactcgctctgcctgcggaggaacaaggtggccattgtggtcagctcgctggactgggtttggaacctggagaaaatggacttgtcgggcaacgagatcgagtacatggagccccatgtgttcgagaccgtgccgcacctgcagtccctgcagctggactccaaccgcctcacctacatcgagccccggatcctcaactcttggaagtccctgacaagcatcaccctggccgggaacctgtgggattgcgggcgcaacgtgtgtgccctagcctcgtggctcagcaacttccaggggcgctacgatggcaacttgcagtgcgccagcccggagtacgcacagggcgaggacgtcctggacgccgtgtacgccttccacctgtgcgaggatggggccgagcccaccagcggccacctgctctcggccgtcaccaaccgcagtgatctggggccccctgccagctcggccaccacgctcgcggacggcggggaggggcagcacgacggcacattcgagcctgccaccgtggctcttccaggcggcgagcacgccgagaacgccgtgcagatccacaaggtggtcacgggcaccatggccctcatcttctccttcctcatcgtggtcctggtgctctacgtgtcctggaagtgtttcccagccagcctcaggcagctcagacagtgctttgtcacgcagcgcaggaagcaaaagcagaaacagaccatgcatcagatggctgccatgtctgcccaggaatactacgttgattacaaaccgaaccacattgagggagccctggtgatcatcaacgagtatggctcgtgtacctgccaccagcagcccgcgagggaatgcgaggtgtgattgtcccagtggctctcaacccatgcgctaccaaatacgcctgggcagccgggacgggccggcgggcaccaggctggggtctccttgtctgtgctctgatatgctccttgactgaaactttaaggggatctctcccagagacttgacattttagctttattgtgtcttaaaaacaaaagcgaattaaaacacaacaaaaaaccccaccccacaaccttcaggacagtctatcttaaatttcatatgagaactccttcctccctttgaagatctgtccatattcaggaatctgagagtgtaaaaaaggtggccataagacagagagagaataatcgtgctttgttttatgctactcctcccaccctgcccatgattaaacatcatgtatgtagaagatcttaagtccatacgcatttcatgaagaaccattggaaagaggaatctgcaatctgggagcttaagagcaaatgatgaccatagaaagctatgttcttactttgtgtgtgtgtctgtatgtttctgcgttgtgtgtctttgtaggcaagcaaacgttgtctacacaaacgggaatttagctcacatcatttcatgcccctgtgcctctagctctggagattggtggggggaggtggggggaaacggcaggaataagggaaagtggtagttttaactaaggttttgtaacacttgaaatcttttctttctcaaattaattatctttaagcttcaagaaacttgctctgacccctctaagcaaactactaagcatttaaaagagaatctaatttttaaaggtgtagcacctttttttttattcttcccacagagggtgctaatctcattatgctgtgctatctgaaaagaacttaaggccacaattcacgtctcgtcctgggcattgtgatggattgaccctccatttgcagtaccttcccagctgattaaagttcagcagtggtattgaggtttttcgaatatttatatagaaaaaaagtcttttcacatgacaaatgacactctcacaccagtcttagccctagtagttttttaggttggaccagaggaagcaggttaaatgagacctgtcctctgctgcactcagaaaaaataggcagtccctgatgctcagatcttagccttgatattaatagttgagaccacctacccacaatgcagcctatactcccaagactacaaagttaccatcgcaaaggaaaggttattccagtaaaaggaaatagttttctcaaccatttaaaaatattcttctgaactcatcaaagtagaagagcccccaaccttttctctctgccttcaagaaggcagacatttggtatgatttagcatcaacaacacatttatgagtatatgtaagtaatcagaggggcaaatgccacttgttattcctcccaagttttccaagcaagtacacacagatctctggtaggattaggggccacttgtgtttccggcttattttagtcgacttgtcagcaagtttgatgcctagtctatctgacatggcccagtagaacagggcattgatggatcacatgagatggtagaaggaacatcatcacatacccctctcacagagaaaattatcaaagaaccagaaattatatctgttttggagcaagagtgtcataatgtttcagggtagtcaaaataaacataaattatctcctctagatgagtggcgatgttggctgatttgggtctgccattgacagaatgtcaaataaaaaggaattagctagaatatgaccattaaatgtgcttctgaaatatattttgagataggtttagaatgtca

SEQ ID NO: 160 - protein, 522 aa, Homo sapiens
MDFLLLGLCLYWLLRRPSGVVLCLLGACFQMLPAAPSGCPQLCRCEGRLLYCEALNLTEAPHNLSGLLGLSLRYNSLSELRAGQFTGLMQLTWLYLDHNHICSVQGDAFQKLRRVKELTLSSNQITQLPNTTFRPMPNLRSVDLSYNKLQALAPDLFHGLRKLTTLHMRANAIQFVPVRIFQDCRSLKFLDIGYNQLKSLARNSFAGLFKLTELHLEHNDLVKVNFAHFPRLISLHSLCLRRNKVAIVVSSLDWVWNLEKMDLSGNEIEYMEPHVFETVPHLQSLQLDSNRLTYIEPRILNSWKSLTSITLAGNLWDCGRNVCALASWLSNFQGRYDGNLQCASPEYAQGEDVLDAVYAFHLCEDGAEPTSGHLLSAVTNRSDLGPPASSATTLADGGEGQHDGTFEPATVALPGGEHAENAVQIHKVVTGTMALIFSFLIVVLVLYVSWKCFPASLRQLRQCFVTQRRKQKQKQTMHQMAAMSAQEYYVDYKPNHIEGALVIINEYGSCTCHQQPARECEV

SEQ ID NO: 161 - DNA, 1674 bp, Homo sapiens
ggccgcctggaattgtgggagttgtgtctgccactcggctgccggaggccgaaggtccgtgactatggctccccagagcctgccttcatctaggatggctcctctgggcatgctgcttgggctgctgatggccgcctgcttcaccttctgcctcagtcatcagaacctgaaggagtttgccctgaccaacccagagaagagcagcaccaaagaaacggagagaaaagaaaccaaagccgaggaggagctggatgccgaagtcctggaggtgttccacccgacgcatgagtggcaggcccttcagccagggcaggctgtccctgcaggatcccacgtacggctgaatcttcagactggggaaagagaggcaaaactccaatatgaggacaagttccgaaataatttgaaaggcaaaaggctggatatcaacaccaacacctacacatctcaggatctcaagagtgcactggcaaaattcaaggagggggcagagatggagagttcaaaggaagacaaggcaaggcaggctgaggtaaagcggctcttccgccccattgaggaactgaagaaagactttgatgagctgaatgttgtcattgagactgacatgcagatcatggtacggctgatcaacaagttcaatagttccagctccagtttggaagagaagattgctgcgctctttgatcttgaatattatgtccatcagatggacaatgcgcaggacctgctttcctttggtggtcttcaagtggtgatcaatgggctgaacagcacagagcccctcgtgaaggagtatgctgcgtttgtgctgggcgctgccttttccagcaaccccaaggtccaggtggaggccatcgaagggggagccctgcagaagctgctggtcatcctggccacggagcagccgctcactgcaaagaagaaggtcctgtttgcactgtgctccctgctgcgccacttcccctatgcccagcggcagttcctgaagctcggggggctgcaggtcctgaggaccctggtgcaggagaagggcacggaggtgctcgccgtgcgcgtggtcacactgctctacgacctggtcacggagaagatgttcgccgaggaggaggctgagctgacccaggagatgtccccagagaagctgcagcagtatcgccaggtacacctcctgccaggcctgtgggaacagggctggtgcgagatcacggcccacctcctggcgctgcccgagcatgatgcccgtgagaaggtgctgcagacactgggcgtcctcctgaccacctgccgggaccgctaccgtcaggacccccagctcggcaggacactggccagcctgcaggctgagtaccaggtgctggccagcctggagctgcaggatggtgaggacgagggctacttccaggagctgctgggctctgtcaacagcttgctgaaggagctgagatgaggccccacaccaggactggactgggatgccgctagtgaggctgaggggtgccagcgtgggtgggcttctcaggcaggaggacatcttggcagtgctggcttggccattaaatggaaacctgaaggccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 162 - protein, 461 aa, Homo sapiens
MAPQSLPSSRMAPLGMLLGLLMAACFTFCLSHQNLKEFALTNPEKSSTKETERKETKAEEELDAEVLEVFHPTHEWQALQPGQAVPAGSHVRLNLQTGEREAKLQYEDKFRNNLKGKRLDINTNTYTSQDLKSALAKFKEGAEMESSKEDKARQAEVKRLFRPIEELKKDFDELNVVIETDMQIMVRLINKFNSSSSSLEEKIAALFDLEYYVHQMDNAQDLLSFGGLQVVINGLNSTEPLVKEYAAFVLGAAFSSNPKVQVEAIEGGALQKLLVILATEQPLTAKKKVLFALCSLLRHFPYAQRQFLKLGGLQVLRTLVQEKGTEVLAVRVVTLLYDLVTEKMFAEEEAELTQEMSPEKLQQYRQVHLLPGLWEQGWCEITAHLLALPEHDAREKVLQTLGVLLTTCRDRYRQDPQLGRTLASLQAEYQVLASLELQDGEDEGYFQELLGSVNSLLKELR

SEQ ID NO: 163 - DNA, 1049 bp, Homo sapiens
cagagaggaggctttgggaattgtccagcagaaacagagaagtctgaggtggtgtcaagacaaaagatgcttcagctttggaaacttgttctcctgtgcggcgtgctcactgggacctcagagtctcttcttgacaatcttggcaatgacctaagcaatgtcgtggataagctggaacctgttcttcacgagggacttgagacagttgacaatactcttaaaggcatccttgagaaactgaaggtcgacctaggagtgcttcagaaatccagtgcttggcaactggccaagcagaaggcccaggaagctgagaaattgctgaacaatgtcatttctaagctgcttccaactaacacggacatttttgggttgaaaatcagcaactccctcatcctggatgtcaaagctgaaccgatcgatgatggcaaaggccttaacctgagcttccctgtcaccgcgaatgtcactgtggccgggcccatcattggccagattatcaacctgaaagcctccttggacctcctgaccgcagtcacaattgaaactgatccccagacacaccagcctgttgccgtcctgggagaatgcgccagtgacccaaccagcatctcactttccttgctggacaaacacagccaaatcatcaacaagttcgtgaatagcgtgatcaacacgctgaaaagcactgtatcctccctgctgcagaaggagatatgtccactgatccgcatcttcatccactccctggatgtgaatgtcattcagcaggtcgtcgataatcctcagcacaaaacccagctgcaaaccctcatctgaagaggacgaatgaggaggaccactgtggtgcatgctgattggttcccagtggcttgccccacccccttatagcatctccctccaggaagctgctgccaccacctaaccagcgtgaaagcctgagtcccaccagaaggaccttcccagataccccttctcctcacagtcagaacagcagcctctacacatgttgtcctgcccctggcaataaaggcccatttctgcacccttaa

SEQ ID NO: 164 - protein, 249 aa, Homo sapiens
MLQLWKLVLLCGVLTGTSESLLDNLGNDLSNVVDKLEPVLHEGLETVDNTLKGILEKLKVDLGVLQKSSAWQLAKQKAQEAEKLLNNVISKLLPTNTDIFGLKISNSLILDVKAEPIDDGKGLNLSFPVTANVTVAGPIIGQIINLKASLDLLTAVTIETDPQTHQPVAVLGECASDPTSISLSLLDKHSQIINKFVNSVINTLKSTVSSLLQKEICPLIRIFIHSLDVNVIQQVVDNPQHKTQLQTLI

SEQ ID NO: 165 - DNA, 1841 bp, Homo sapiens
gcagtcagagacttcccctgcccctcgctgggaaagaacattaggaatgccttttagtgccttgcttcctgaactagctcacagtagcccggcggcccagggcaatccgaccacatttcactctcaccgctgtaggaatccagatgcaggccaagtacagcagcacgagggacatgctggatgatgatggggacaccaccatgagcctgcattctcaagcctctgccacaactcggcatccagagccccggcgcacagagcacagggctccctcttcaacgtggcgaccagtggccctgaccctgctgactttgtgcttggtgctgctgatagggctggcagccctggggcttttgttttttcagtactaccagctctccaatactggtcaagacaccatttctcaaatggaagaaagattaggaaatacgtcccaagagttgcaatctcttcaagtccagaatataaagcttgcaggaagtctgcagcatgtggctgaaaaactctgtcgtgagctgtataacaaagctggagcacacaggtgcagcccttgtacagaacaatggaaatggcatggagacaattgctaccagttctataaagacagcaaaagttgggaggactgtaaatatttctgccttagtgaaaactctaccatgctgaagataaacaaacaagaagacctggaatttgccgcgtctcagagctactctgagtttttctactcttattggacagggcttttgcgccctgacagtggcaaggcctggctgtggatggatggaacccctttcacttctgaactgttccatattataatagatgtcaccagcccaagaagcagagactgtgtggccatcctcaatgggatgatcttctcaaaggactgcaaagaattgaagcgttgtgtctgtgagagaagggcaggaatggtgaagccagagagcctccatgtcccccctgaaacattaggcgaaggtgactgattcgccctctgcaactacaaatagcagagtgagccaggcggtgccaaagcaagggctagttgagacattgggaaatggaacataatcaggaaagactatctctctgactagtacaaaatgggttctcgtgtttcctgttcaggatcaccagcatttctgagcttgggtttatgcacgtatttaacagtcacaagaagtcttatttacatgccaccaaccaacctcagaaacccataatgtcatctgccttcttggcttagagataacttttagctctctttcttctcaatgtctaatatcacctccctgttttcatgtcttccttacacttggtggaataagaaactttttgaagtagaggaaatacattgaggtaacatccttttctctgacagtcaagtagtccatcagaaattggcagtcacttcccagattgtaccagcaaatacacaaggaattctttttgtttgtttcagttcatactagtcccttcccaatccatcagtaaagaccccatctgccttgtccatgccgtttcccaacagggatgtcacttgatatgagaatctcaaatctcaatgccttataagcattccttcctgtgtccattaagactctgataattgtctcccctccataggaatttctcccaggaaagaaatatatccccatctccgtttcatatcagaactaccgtccccgatattcccttcagagagattaaagaccagaaaaaagtgagcctcttcatctgcacctgtaatagtttcagttcctattttcttccattgacccatatttatacctttcaggtactgaagatttaataataataaatgtaaatactgtgaaaaa

SEQ ID NO: 166 - protein, 280 aa, Homo sapiens [sequence omitted]

SEQ ID NO: 167 - DNA, 1238 bp, Homo sapiens
gcgacgggcaggacgccccgttcgcctagcgcgtgctcaggagttggtgtcctgcctgcgctcaggatgagggggaatctggccctggtgggcgttctaatcagcctggccttcctgtcactgctgccatctggacatcctcagccggctggcgatgacgcctgctctgtgcagatcctcgtccctggcctcaaaggggatgcgggagagaagggagacaaaggcgcccccggacggcctggaagagtcggccccacgggagaaaaaggagacatgggggacaaaggacagaaaggcagtgtgggtcgtcatggaaaaattggtcccattggctctaaaggtgagaaaggagattccggtgacataggaccccctggtcctaatggagaaccaggcctcccatgtgagtgcagccagctgcgcaaggccatcggggagatggacaaccaggtctctcagctgaccagcgagctcaagttcatcaagaatgctgtcgccggtgtgcgcgagacggagagcaagatctacctgctggtgaaggaggagaagcgctacgcggacgcccagctgtcctgccagggccgcgggggcacgctgagcatgcccaaggacgaggctgccaatggcctgatggccgcatacctggcgcaagccggcctggcccgtgtcttcatcggcatcaacgacctggagaaggagggcgccttcgtgtactctgaccactcccccatgcggaccttcaacaagtggcgcagcggtgagcccaacaatgcctacgacgaggaggactgcgtggagatggtggcctcgggcggctggaacgacgtggcctgccacaccaccatgtacttcatgtgtgagtttgacaaggagaacatgtgagcctcaggctggggctgcccattgggggccccacatgtccctgcagggttggcagggacagagcccagaccatggtgccagccagggagctgtccctctgtgaagggtggaggctcactgagtagagggctgttgtctaaactgagaaaatggcctatgcttaagaggaaaatgaaagtgttcctggggtgctgtctctgaagaagcagagtttcattacctgtattgtagccccaatgtcattatgtaattattacccagaattgctcttccataaagcttgtgcctttgtccaagctatacaataaaatctttaagtagtgcagtagttaagtccaaaaaaaaaaaaaaaaaaa

SEQ ID NO: 168 - protein, 271 aa, Homo sapiens
MRGNLALVGVLISLAFLSLLPSGHPQPAGDDACSVQILVPGLKGDAGEKGDKGAPGRPGRVGPTGEKGDMGDKGQKGSVGRHGKIGPIGSKGEKGDSGDIGPPGPNGEPGLPCECSQLRKAIGEMDNQVSQLTSELKFIKNAVAGVRETESKIYLLVKEEKRYADAQLSCQGRGGTLSMPKDEAANGLMAAYLAQAGLARVFIGINDLEKEGAFVYSDHSPMRTFNKWRSGEPNNAYDEEDCVEMVASGGWNDVACHTTMYFMCEFDKENM

SEQ ID NO: 169 - DNA, 972 bp, Homo sapiens
agtgactgcagccttcctagatcccctccactcggtttctctctttgcaggagcaccggcagcaccagtgtgtgaggggagcaggcagcggtcctagccagttccttgatcctgccagaccacccagcccccggcacagagctgctccacaggcaccatgaggatcatgctgctattcacagccatcctggccttcagcctagctcagagctttggggctgtctgtaaggagccacaggaggaggtggttcctggcgggggccgcagcaagagggatccagatctctaccagctgctccagagactcttcaaaagccactcatctctggagggattgctcaaagccctgagccaggctagcacagatcctaaggaatcaacatctcccgagaaacgtgacatgcatgacttctttgtgggacttatgggcaagaggagcgtccagccagagggaaagacaggacctttcttaccttcagtgagggttcctcggccccttcatcccaatcagcttggatccacaggaaagtcttccctgggaacagaggagcagagacctttataagactctcctacggatgtgaatcaagagaacgtccccagctttggcatcctcaagtatcccccgagagcagaataggtactccacttccggactcctggactgcattaggaagacctctttccctgtcccaatccccaggtgcgcacgctcctgttaccctttctcttccctgttcttgtaacattcttgtgctttgactccttctccatcttttctacctgaccctggtgtggaaactgcatagtgaatatccccaaccccaatgggcattgactgtagaataccctagagttcctgtagtgtcctacattaaaaatataatgtctctctctattcctcaacaataaaggatttttgcatatgaaaaaaaaaaaaaaaaaaaaaaaaaaaaaaaaaaaaaaaaaaaa

SEQ ID NO: 170 - protein, 135 aa, Homo sapiens
MRIMLLFTAILAFSLAQSFGAVCKEPQEEVVPGGGRSKRDPDLYQLLQRLFKSHSSLEGLLKALSQASTDPKESTSPEKRDMHDFFVGLMGKRSVQPEGKTGPFLPSVRVPRPLHPNQLGSTGKSSLGTEEQRPL

SEQ ID NO: 171 - DNA, 1415 bp, Homo sapiens
tggcctccccagcttgccaggcacaaggctgagcgggaggaagcgagaggcatctaagcaggcagtgttttgccttcaccccaagtgaccatgagaggtgccacgcgagtctcaatcatgctcctcctagtaactgtgtctgactgtgctgtgatcacaggggcctgtgagcgggatgtccagtgtggggcaggcacctgctgtgccatcagcctgtggcttcgagggctgcggatgtgcaccccgctggggcgggaaggcgaggagtgccaccccggcagccacaaggtccccttcttcaggaaacgcaagcaccacacctgtccttgcttgcccaacctgctgtgctccaggttcccggacggcaggtaccgctgctccatggacttgaagaacatcaatttttaggcgcttgcctggtctcaggatacccaccatccttttcctgagcacagcctggatttttatttctgccatgaaacccagctcccatgactctcccagtccctacactgactaccctgatctctcttgtctagtacgcacatatgcacacaggcagacatacctcccatcatgacatggtccccaggctggcctgaggatgtcacagcttgaggctgtggtgtgaaaggtggccagcctggttctcttccctgctcaggctgccagagaggtggtaaatggcagaaaggacattccccctcccctccccaggtgacctgctctctttcctgggccctgcccctctccccacatgtatccctcggtctgaattagacattcctgggcacaggctcttgggtgcattgctcagagtcccaggtcctggcctgaccctcaggcccttcacgtgaggtctgtgaggaccaatttgtgggtagttcatcttccctcgattggttaactccttagtttcagaccacagactcaagattggctcttcccagagggcagcagacagtcaccccaaggcaggtgtagggagcccagggaggccaatcagccccctgaagactctggtcccagtcagcctgtggcttgtggcctgtgacctgtgaccttctgccagaattgtcatgcctctgaggccccctcttaccacactttaccagttaaccactgaagcccccaattcccacagcttttccattaaaatgcaaatggtggtggttcaatctaatctgatattgacatattagaaggcaattagggtgtttccttaaacaactcctttccaaggatcagccctgagagcaggttggtgactttgaggagggcagtcctctgtccagattggggtgggagcaagggacagggagcagggcaggggctgaaaggggcactgattcagaccagggaggcaactacacaccaacatgctggctttagaataaaagcaccaactgaaaaaa

SEQ ID NO: 172 - protein, 105 aa, Homo sapiens
MRGATRVSIMLLLVTVSDCAVITGACERDVQCGAGTCCAISLWLRGLRMCTPLGREGEECHPGSHKVPFFRKRKHHTCPCLPNLLCSRFPDGRYRCSMDLKNINF

SEQ ID NO: 173 - DNA, 1281 bp, Homo sapiens
agcgcccgggcgtcggggcggtaaaaggccggcagaagggaggcacttgagaaatgtctttcctccaggacccaagtttcttcaccatggggatgtggtccattggtgcaggagccctgggggctgctgccttggcattgctgcttgccaacacagacgtgtttctgtccaagccccagaaagcggccctggagtacctggaggatatagacctgaaaacactggagaaggaaccaaggactttcaaagcaaaggagctatgggaaaaaaatggagctgtgattatggccgtgcggaggccaggctgtttcctctgtcgagaggaagctgcggatctgtcctccctgaaaagcatgttggaccagctgggcgtccccctctatgcagtggtaaaggagcacatcaggactgaagtgaaggatttccagccttatttcaaaggagaaatcttcctggatgaaaagaaaaagttctatggtccacaaaggcggaagatgatgtttatgggatttatccgtctgggagtgtggtacaacttcttccgagcctggaacggaggcttctctggaaacctggaaggagaaggcttcatccttgggggagttttcgtggtgggatcaggaaagcagggcattcttcttgagcaccgagaaaaagaatttggagacaaagtaaacctactttctgttctggaagctgctaagatgatcaaaccacagactttggcctcagagaaaaaatgattgtgtgaaactgcccagctcagggataaccagggacattcacctgtgttcatgggatgtattgtttccactcgtgtccctaaggagtgagaaacccatttatactctactctcagtatggattattaatgtattttaatattctgtttaggcccactaaggcaaaatagccccaaaacaagactgacaaaaatctgaaaaactaatgaggattattaagctaaaacctgggaaataggaggcttaaaattgactgccaggctgggtgcagtggctcacacctgtaatcccagcactttgggaggccaaggtgagcaagtcacttgaggtcgggagttcgagaccagcctgagcaacatggcgaaaccccgtctctactaaaaatacaaaaatcacccgggtgtggtggcaggcacctgtagtcccagctacccgggaggctgaggcaggagaatcacttgaacctgggaggtggaggttgcggtgagctgagatcacaccactgtattccagcctgggtgactgagactctaactaa

SEQ ID NO: 174 - protein, 229 aa, Homo sapiens
MSFLQDPSFFTMGMWSIGAGALGAAALALLLANTDVFLSKPQKAALEYLEDIDLKTLEKEPRTFKAKELWEKNGAVIMAVRRPGCFLCREEAADLSSLKSMLDQLGVPLYAVVKEHIRTEVKDFQPYFKGEIFLDEKKKFYGPQRRKMMFMGFIRLGVWYNFFRAWNGGFSGNLEGEGFILGGVFVVGSGKQGILLEHREKEFGDKVNLLSVLEAAKMIKPQTLASEKK

SEQ ID NO: 175 - DNA, 1844 bp, Homo sapiens
gacagtggagggcagtggagaggaccgcgctgtcctgctgtcaccaagagctggagacaccatctcccaccgagagtcatggccccattggccctgcacctcctcgtcctcgtccccatcctcctcagcctggtggcctcccaggactggaaggctgaacgcagccaagaccccttcgagaaatgcatgcaggatcctgactatgagcagctgctcaaggtggtgacctgggggctcaatcggaccctgaagccccagagggtgattgtggttggcgctggtgtggccgggctggtggccgccaaggtgctcagcgatgctggacacaaggtcaccatcctggaggcagataacaggatcgggggccgcatcttcacctaccgggaccagaacacgggctggattggggagctgggagccatgcgcatgcccagctctcacaggatcctccacaagctctgccagggcctggggctcaacctgaccaagttcacccagtacgacaagaacacgtggacggaggtgcacgaagtgaagctgcgcaactatgtggtggagaaggtgcccgagaagctgggctacgccttgcgtccccaggaaaagggccactcgcccgaagacatctaccagatggctctcaaccaggccctcaaagacctcaaggcactgggctgcagaaaggcgatgaagaagtttgaaaggcacacgctcttggaatatcttctcggggaggggaacctgagccggccggccgtgcagcttctgggagacgtgatgtccgaggatggcttcttctatctcagcttcgccgaggccctccgggcccacagctgcctcagcgacagactccagtacagccgcatcgtgggtggctgggacctgctgccgcgcgcgctgctgagctcgctgtccgggcttgtgctgttgaacgcgcccgtggtggcgatgacccagggaccgcacgatgtgcacgtgcagatcgagacctctcccccggcgcggaatctgaaggtgctgaaggccgacgtggtgctgctgacggcgagcggaccggcggtgaagcgcatcaccttctcgccgccgctgccccgccacatgcaggaggcgctgcggaggctgcactacgtgccggccaccaaggtgttcctaagcttccgcaggcccttctggcgcgaggagcacattgaaggcggccactcaaacaccgatcgcccgtcgcgcatgattttctacccgccgccgcgcgagggcgcgctgctgctggcctcgtacacgtggtcggacgcggcggcagcgttcgccggcttgagccgggaagaggcgttgcgcttggcgctcgacgacgtggcggcattgcacgggcctgtcgtgcgccagctctgggacggcaccggcgtcgtcaagcgttgggcggaggaccagcacagccagggtggctttgtggtacagccgccggcgctctggcaaaccgaaaaggatgactggacggtcccttatggccgcatctactttgccggcgagcacaccgcctacccgcacggctgggtggagacggcggtcaagtcggcgctgcgcgccgccatcaagatcaacagccggaaggggcctgcatcggacacggccagccccgaggggcacgcatctgacatggaggggcaggggcatgtgcatggggtggccagcagcccctcgcatgacctggcaaaggaagaaggcagccaccctccagtccaaggccagttatctctccaaaacacgacccacacgaggacctcgcattaaagtattttcggaaaaaaaaaaaaaaaaaaaaaaaaaaaaaaaaaaaaaaaaaaaaaaaaaaa

SEQ ID NO: 176 - protein, 567 aa, Homo sapiens
MAPLALHLLVLVPILLSLVASQDWKAERSQDPFEKCMQDPDYEQLLKVVTWGLNRTLKPQRVIVVGAGVAGLVAAKVLSDAGHKVTILEADNRIGGRIFTYRDQNTGWIGELGAMRMPSSHRILHKLCQGLGLNLTKFTQYDKNTWTEVHEVKLRNYVVEKVPEKLGYALRPQEKGHSPEDIYQMALNQALKDLKALGCRKAMKKFERHTLLEYLLGEGNLSRPAVQLLGDVMSEDGFFYLSFAEALRAHSCLSDRLQYSRIVGGWDLLPRALLSSLSGLVLLNAPVVAMTQGPHDVHVQIETSPPARNLKVLKADVVLLTASGPAVKRITFSPPLPRHMQEALRRLHYVPATKVFLSFRRPFWREEHIEGGHSNTDRPSRMIFYPPPREGALLLASYTWSDAAAAFAGLSREEALRLALDDVAALHGPVVRQLWDGTGVVKRWAEDQHSQGGFVVQPPALWQTEKDDWTVPYGRIYFAGEHTAYPHGWVETAVKSALRAAIKINSRKGPASDTASPEGHASDMEGQGHVHGVASSPSHDLAKEEGSHPPVQGQLSLQNTTHTRTSH

SEQ ID NO: 177 - DNA, 1215 bp, Homo sapiens
ccggggaggggagggcccgtcccgcccctccccgtctctccccgcccctccccgtccctcccgccgaagctccgtcccgcccgcgggccggctccgccctcacctcccggccgcggctgccctctgcccgggttgtccaagatggagggcgctccaccggggtcgctcgccctccggctcctgctgttcgtggcgctacccgcctccggctggctgacgacgggcgcccccgagccgccgccgctgtccggagccccacaggacggcatcagaattaatgtaactacactgaaagatgatggggacatatctaaacagcaggttgttcttaacataacctatgagagtggacaggtgtatgtaaatgacttacctgtaaatagtggtgtaacccgaataagctgtcagactttgatagtgaagaatgaaaatcttgaaaatttggaggaaaaagaatattttggaattgtcagtgtaaggattttagttcatgagtggcctatgacatctggttccagtttgcaactaattgtcattcaagaagaggtagtagagattgatggaaaacaagttcagcaaaaggatgtcactgaaattgatattttagttaagaaccggggagtactcagacattcaaactataccctccctttggaagaaagcatgctctactctatttctcgagacagtgacattttatttacccttcctaacctctccaaaaaagaaagtgttagttcactgcaaaccactagccagtatcttatcaggaatgtggaaaccactgtagatgaagatgttttacctggcaagttacctgaaactcctctcagagcagagccgccatcttcatataaggtaatgtgtcagtggatggaaaagtttagaaaagatctgtgtaggttctggagcaacgttttcccagtattctttcagtttttgaacatcatggtggttggaattacaggagcagctgtggtaataaccatcttaaaggtgtttttcccagtttctgaatacaaaggaattcttcagttggataaagtggacgtcatacctgtgacagctatcaacttatatccagatggtccagagaaaagagctgaaaaccttgaagataaaacatgtatttaaaacgccatctcatatcatggactccgaagtagcctgttgcctccaaatttgccacttgaatataattttctttaaatcgtt

SEQ ID NO: 178 - protein, 330 aa, Homo sapiens
MEGAPPGSLALRLLLFVALPASGWLTTGAPEPPPLSGAPQDGIRINVTTLKDDGDISKQQVVLNITYESGQVYVNDLPVNSGVTRISCQTLIVKNENLENLEEKEYFGIVSVRILVHEWPMTSGSSLQLIVIQEEVVEIDGKQVQQKDVTEIDILVKNRGVLRHSNYTLPLEESMLYSISRDSDILFTLPNLSKKESVSSLQTTSQYLIRNVETTVDEDVLPGKLPETPLRAEPPSSYKVMCQWMEKFRKDLCRFWSNVFPVFFQFLNIMVVGITGAAVVITILKVFFPVSEYKGILQLDKVDVIPVTAINLYPDGPEKRAENLEDKTCI

SEQ ID NO: 179 - DNA, 3877 bp, Homo sapiens
ctccttaggtggaaaccctgggagtagagtactgacagcaaagaccgggaaagaccatacgtccccgggcaggggtgacaacaggtgtcatctttttgatctcgtgtgtggctgccttcctatttcaaggaaagacgccaaggtaattttgacccagaggagcaatgatgtagccacctcctaaccttcccttcttgaacccccagttatgccaggatttactagagagtgtcaactcaaccagcaagcggctccttcggcttaacttgtggttggaggagagaacctttgtggggctgcgttctcttagcagtgctcagaagtgacttgcctgagggtggaccagaagaaaggaaaggtcccctcttgctgttggctgcacatcaggaaggctgtgatgggaatgaaggtgaaaacttggagatttcacttcagtcattgcttctgcctgcaagatcatcctttaaaagtagagaagctgctctgtgtggtggttaactccaagaggcagaactcgttctagaaggaaatggatgcaagcagctccgggggccccaaacgcatgcttcctgtggtctagcccagggaagcccttccgtgggggccccggctttgagggatgccaccggttctggacgcatggctgattcctgaatgatgatggttcgccgggggctgcttgcgtggatttcccgggtggtggttttgctggtgctcctctgctgtgctatctctgtcctgtacatgttggcctgcaccccaaaaggtgacgaggagcagctggcactgcccagggccaacagccccacggggaaggaggggtaccaggccgtccttcaggagtgggaggagcagcaccgcaactacgtgagcagcctgaagcggcagatcgcacagctcaaggaggagctgcaggagaggagtgagcagctcaggaatgggcagtaccaagccagcgatgctgctggcctgggtctggacaggagccccccagagaaaacccaggccgacctcctggccttcctgcactcgcaggtggacaaggcagaggtgaatgctggcgtcaagctggccacagagtatgcagcagtgcctttcgatagctttactctacagaaggtgtaccagctggagactggccttacccgccaccccgaggagaagcctgtgaggaaggacaagcgggatgagttggtggaagccattgaatcagccttggagaccctgaacaatcctgcagagaacagccccaatcaccgtccttacacggcctctgatttcatagaagggatctaccgaacagaaagggacaaagggacattgtatgagctcaccttcaaaggggaccacaaacacgaattcaaacggctcatcttatttcgaccattcagccccatcatgaaagtgaaaaatgaaaagctcaacatggccaacacgcttatcaatgttatcgtgcctctagcaaaaagggtggacaagttccggcagttcatgcagaatttcagggagatgtgcattgagcaggatgggagagtccatctcactgttgtttactttgggaaagaagaaataaatgaagtcaaaggaatacttgaaaacacttccaaagctgccaacttcaggaactttaccttcatccagctgaatggagaattttctcggggaaagggacttgatgttggagcccgcttctggaagggaagcaacgtccttctctttttctgtgatgtggacatctacttcacatctgaattcctcaatacgtgtaggctgaatacacagccagggaagaaggtattttatccagttcttttcagtcagtacaatcctggcataatatacggccaccatgatgcagtccctcccttggaacagcagctggtcataaagaaggaaactggattttggagagactttggatttgggatgacgtgtcagtatcggtcagacttcatcaatataggtgggtttgatctggacatcaaaggctggggcggagaggatgtgcacctttatcgcaagtatctccacagcaacctcatagtggtacggacgcctgtgcgaggactcttccacctctggcatgagaagcgctgcatggacgagctgacccccgagcagtacaagatgtgcatgcagtccaaggccatgaacgaggcatcccacggccagctgggcatgctggtgttcaggcacgagatagaggctcaccttcgcaaacagaaacagaagacaagtagcaaaaaaacatgaactcccagagaaggattgtgggagacactttttctttccttttgcaattactgaaagtggctgcaacagagaaaagacttccataaaggacgacaaaagaattggactgatgggtcagagatgagaaagcctccgatttctctctgttgggctttttacaacagaaatcaaaatctccgctttgcctgcaaaagtaacccagttgcaccctgtgaagtgtctgacaaaggcagaatgcttgtgagattataagcctaatggtgtggaggttttgatggtgtttacaatacactgagacctgttgttttgtgtgctcattgaaatattcatgatttaagagcagttttgtaaaaaattcattagcatgaaaggcaagcatatttctcctcatatgaatgagcctatcagcagggctctagtttctaggaatgctaaaatatcagaaggcaggagaggagataggcttattatgatactagtgagtacattaagtaaaataaaatggaccagaaaagaaaagaaaccataaatatcgtgtcatattttccccaagattaaccaaaaataatctgcttatctttttggttgtccttttaactgtctccgtttttttcttttatttaaaaatgcactttttttcccttgtgagttatagtctgcttatttaattaccactttgcaagccttacaagagagcacaagttggcctacatttttatattttttaagaagatactttgagatgcattatgagaactttcagttcaaagcatcaaattgatgccatatccaaggacatgccaaatgctgattctgtcaggcactgaatgtcaggcattgagacatagggaaggaatggtttgtactaatacagacgtacagatactttctctgaagagtattttcgaagaggagcaactgaacactggaggaaaagaaaatgacactttctgctttacagaaaaggaaactcattcagactggtgatatcgtgatgtacctaaaagtcagaaaccacattttctcctcagaagtagggaccgctttcttacctgtttaaataaaccaaagtataccgtgtgaaccaaacaatctcttttcaaaacagggtgctcctcctggcttctggcttccataagaagaaatggagaaaaatatatatatatatatatatattgtgaaagatcaatccatctgccagaatctagtgggatggaagtttttgctacatgttatccaccccaggccaggtggaagtaactgaattattttttaaattaagcagttctactcaatcaccaagatgcttctgaaaattgcattttattaccatttcaaactattttttaaaaataaatacagttaacatagagtggtttcttcattcatgtgaaaattattagccagcaccagatgcatgagctaattatctctttgagtccttgcttctgtttgctcacagtaaactcattgtttaaaagcttcaagaacattcaagctgttggtgtgttaaaaaatgcattgtattgatttgtactggtagtttatgaaatttaattaaaacacaggccatgaatggaaggtggtattgcacagctaataaaatatgatttgtggatatgaa

SEQ ID NO: 180 - protein, 532 aa, Homo sapiens
MMMVRRGLLAWISRVVVLLVLLCCAISVLYMLACTPKGDEEQLALPRANSPTGKEGYQAVLQEWEEQHRNYVSSLKRQIAQLKEELQERSEQLRNGQYQASDAAGLGLDRSPPEKTQADLLAFLHSQVDKAEVNAGVKLATEYAAVPFDSFTLQKVYQLETGLTRHPEEKPVRKDKRDELVEAIESALETLNNPAENSPNHRPYTASDFIEGIYRTERDKGTLYELTFKGDHKHEFKRLILFRPFSPIMKVKNEKLNMANTLINVIVPLAKRVDKFRQFMQNFREMCIEQDGRVHLTVVYFGKEEINEVKGILENTSKAANFRNFTFIQLNGEFSRGKGLDVGARFWKGSNVLLFFCDVDIYFTSEFLNTCRLNTQPGKKVFYPVLFSQYNPGIIYGHHDAVPPLEQQLVIKKETGFWRDFGFGMTCQYRSDFINIGGFDLDIKGWGGEDVHLYRKYLHSNLIVVRTPVRGLFHLWHEKRCMDELTPEQYKMCMQSKAMNEASHGQLGMLVFRHEIEAHLRKQKQKTSSKKT

SEQ ID NO: 181 - DNA, 2498 bp, Homo sapiens
cgtctctgcgttcgccatgcgtcccggggcgccagggccactctggcctctgccctggggggccctggcttgggccgtgggcttcgtgagctccatgggctcggggaaccccgcgcccggtggtgtttgctggctccagcagggccaggaggccacctgcagcctggtgctccagactgatgtcacccgggccgagtgctgtgcctccggcaacattgacaccgcctggtccaacctcacccacccggggaacaagatcaacctcctcggcttcttgggccttgtccactgccttccctgcaaagattcgtgcgacggcgtggagtgcggcccgggcaaggcgtgccgcatgctggggggccgcccgcgctgcgagtgcgcgcccgactgctcggggctcccggcgcggctgcaggtctgcggctcagacggcgccacctaccgcgacgagtgcgagctgcgcgccgcgcgctgccgcggccacccggacctgagcgtcatgtaccggggccgctgccgcaagtcctgtgagcacgtggtgtgcccgcggccacagtcgtgcgtcgtggaccagacgggcagcgcccactgcgtggtgtgtcgagcggcgccctgccctgtgccctccagccccggccaggagctttgcggcaacaacaacgtcacctacatctcctcgtgccacatgcgccaggccacctgcttcctgggccgctccatcggcgtgcgccacgcgggcagctgcgcaggcacccctgaggagccgccaggtggtgagtctgcagaagaggaagagaacttcgtgtgagcctgcaggacaggcctgggcctggtgcccgaggccccccatcatcccctgttatttattgccacagcagagtctaatttatatgccacggacactccttagagcccggattcggaccacttggggatcccagaacctccctgacgatatcctggaaggactgaggaagggaggcctgggggccggctggtgggtgggatagacctgcgttccggacactgagcgcctgatttagggcccttctctaggatgccccagcccctaccctaagacctattgccggggaggattccacacttccgctcctttggggataaacctattaattattgctactatcaagagggctgggcattctctgctggtaattcctgaagaggcatgactgcttttctcagccccaagcctctagtctgggtgtgtacggagggtctagcctgggtgtgtacggagggtctagcctgggtgagtacggagggtctagcctgggtgagtacggagggtctagcctgggtgagtacggagggtctagcctgggtgtgtatggaggatctagcctgggtgagtatggagggtctagcctgggtgagtatggagggtctagcctgggtgtgtatggagggtctagcctgggtgagtatggagggtctagcctgggtgtgtatggagggtctagcctgggtgagtatggagggtctagcctgggtgtgtacggagggtctagtctgagtgcgtgtggggacctcagaacactgtgaccttagcccagcaagccaggcccttcatgaaggccaagaaggctgccaccattccctgccagcccaagaactccagcttccccactgcctctgtgtgcccctttgcgtcctgtgaaggccattgagaaatgcccagtgtgccccctgggaaagggcacggcctgtgctcctgacacgggctgtgcttggccacagaaccacccagcgtctcccctgctgctgtccacgtcagttcatgaggcaacgtcgcgtggtctcagacgtggagcagccagcggcagctcagagcagggcactgtgtccggcggagccaagtccactctgggggagctctggcggggaccacgggccactgctcacccactggccccgaggggggtgtagacgccaagactcacgcatgtgtgacatccggagtcctggagccgggtgtcccagtggcaccactaggtgcctgctgcctccacagtggggttcacacccagggctccttggtcccccacaacctgccccggccaggcctgcagacccagactccagccagacctgcctcacccaccaatgcagccggggctggcgacaccagccaggtgctggtcttgggccagttctcccacgacggctcaccctcccctccatctgcgttgatgctcagaatcgcctacctgtgcctgcgtgtaaaccacagcctcagaccagctatggggagaggacaacacggaggatatccagcttccccggtctggggtgaggaatgtggggagcttgggcatcctcctccagcctcctccagcccccaggcagtgccttacctgtggtgcccagaaaagtgcccctaggttggtgggtctacaggagcctcagccaggcagcccaccccaccctggggccctgcctcaccaaggaaataaagactcaagccataaaaaaaa

SEQ ID NO: 182 - protein, 263 aa, Homo sapiens
MRPGAPGPLWPLPWGALAWAVGFVSSMGSGNPAPGGVCWLQQGQEATCSLVLQTDVTRAECCASGNIDTAWSNLTHPGNKINLLGFLGLVHCLPCKDSCDGVECGPGKACRMLGGRPRCECAPDCSGLPARLQVCGSDGATYRDECELRAARCRGHPDLSVMYRGRCRKSCEHVVCPRPQSCVVDQTGSAHCVVCRAAPCPVPSSPGQELCGNNNVTYISSCHMRQATCFLGRSIGVRHAGSCAGTPEEPPGGESAEEEENFV

SEQ ID NO: 183 - DNA, 1808 bp, Homo sapiens
cactcattcattccaaagggtctctcaaggcaatggtaatgtgcaaggaggtgatacctaaatgaatgaccaaaagaacatgcttctgcttttgtgtgtctcctacattttagacatttgtttgtttctcttggtagcctttaaattccttgaagcccaggaccatgtctcacttacctttgtgtttccactaactagtctacctcctggaattggcagatactcagtgaaagcctgtgaaataagtgatgtctatttctagcatattattctgagatttaatgatagatttagtgattgaatgagatttccattttcaaatacagcaaaagcataactattttcattcattcatattcattcaacttcattctcaaaattaggtcctgagttaactaataattacctttgaaatgtgtgggttatttgaggcaatcaggtggtgacattgagctctcagccagagtttgtttctggaattgattcagttccattgcattgatttttgttctcagaagccaaggtttcccatgaaaaatcattcccacttgaattgggctgtgattcttgctgcgtttaagtaaaggaagcctcttggttctagttctgcaaacttacacactgaactgggacaagtttttgtttagagtaatggctgggaaaagaggaacctttcattttattcagaagtcaaaaacaaaggcctcccagccacctggagatgttttgttgcagacaccagcctggctctgtctttatgcctaacaattgagcatccagtcttctttgtgctgggaccattgctcagctctgcaaggggaaaagagggagaaagccagagctgccaggcttcttgcactggggccgggggagggttcctgggaagcaggtgctctctggcttcttggtacgtgaggctctcggagctgcctctcctctgaccctcaggtcctcaccgagtttgctccaggagtatattgaaaacatacccagtgctctctcaagcacccactgcttagagggcccagatttcttttccttctttcccttgcagagctggagactgcatcgggcatctggtgtttaaactaaacaggaaaactgactaaaggtccacagtgctcattgtgtagactagctgccctccgatgggtgctctgattatcagtggttccagtgcagggcctgtcactaaacaggcctcacttcctccttgggggctttcccatgggaggtgtggctttttactctacatggaaatgactctctgcagccacagaacacagtcattttctgaattatcccagtctctcatgcgccctggattcctccagatgccttatatctcttgtgcaaagttgtctaaaatttggttcccagcttccaagccttgccttttggccttcctggaagtatttttgttgatgagtcgtctgtcattattctctaaaatgatttgctttttgtttctttcattcctatttccaccccacatatacacacatgcttcttaacttaggggattacatgccaataaatctattgttgaaaatgcactaatactatcgcaaagacgaaaattcacaggctgaaccgttgtaagtccatatgctcctcaacttacatgtgtgatggagttatgcccaaataagtccatcgtcaagttgaaaaatcaaaatcaagccatcttaggttgaggaccatttgtttgtacctccaaagatgtcatatctttaaacatactccctagcttttctttttactttttattttgaagtaattatagaatcacagaaagttgcaaaaaa

SEQ ID NO: 184 - protein, 121 aa, Homo sapiens
MGALIISGSSAGPVTKQASLPPWGLSHGRCGFLLYMEMTLCSHRTQSFSELSQSLMRPGFLQMPYISCAKLSKIWFPASKPCLLAFLEVFLLMSRLSLFSKMICFLFLSFLFPPHIYTHAS

SEQ ID NO: 185 - DNA, 1371 bp, Homo sapiens
aactcaaactcctctctctgggaaaacgcggtgcttgctcctcccggagtggccttggcagggtgttggagccctcggtctgccccgtccggtctctggggccaaggctgggtttccctcatgtatggcaagagctctactcgtgcggtgcttcttctccttggcatacagctcacagctctttggcctatagcagctgtggaaatttatacctcccgggtgctggaggctgttaatgggacagatgctcggttaaaatgcactttctccagctttgcccctgtgggtgatgctctaacagtgacctggaattttcgtcctctagacgggggacctgagcagtttgtattctactaccacatagatcccttccaacccatgagtgggcggtttaaggaccgggtgtcttgggatgggaatcctgagcggtacgatgcctccatccttctctggaaactgcagttcgacgacaatgggacatacacctgccaggtgaagaacccacctgatgttgatggggtgataggggagatccggctcagcgtcgtgcacactgtacgcttctctgagatccacttcctggctctggccattggctctgcctgtgcactgatgatcataatagtaattgtagtggtcctcttccagcattaccggaaaaagcgatgggccgaaagagctcataaagtggtggagataaaatcaaaagaagaggaaaggctcaaccaagagaaaaaggtctctgtttatttagaagacacagactaacaattttagatggaagctgagatgatttccaagaacaagaaccctagtatttcttgaagttaatggaaacttttctttggcttttccagttgtgacccgttttccaaccagttctgcagcatattagattctagacaagcaacacccctctggagccagcacagtgctcctccatatcaccagtcatacacagcctcattattaaggtcttatttaatttcagagtgtaaattttttcaagtgctcattaggttttataaacaagaagctacatttttgcccttaagacactacttacagtgttatgacttgtatacacatatattggtatcaaaggggataaaagccaatttgtctgttacatttcctttcacgtatttcttttagcagcacttctgctactaaagttaatgtgtttactctctttccttcccacattctcaattaaaaggtgagctaagcctcctcggtgtttctgattaacagtaaatcctaaattcaaactgttaaatgacatttttatttttatgtctctccttaactatgagacacatcttgttttactgaatttctttcaatattccaggtgatagatttttgtcg

SEQ ID NO: 186 - protein, 215 aa, Homo sapiens
MYGKSSTRAVLLLLGIQLTALWPIAAVEIYTSRVLEAVNGTDARLKCTFSSFAPVGDALTVTWNFRPLDGGPEQFVFYYHIDPFQPMSGRFKDRVSWDGNPERYDASILLWKLQFDDNGTYTCQVKNPPDVDGVIGEIRLSVVHTVRFSEIHFLALAIGSACALMIIIVIVVVLFQHYRKKRWAERAHKVVEIKSKEEERLNQEKKVSVYLEDTD

SEQ ID NO: 187 - DNA, 471 bp, Homo sapiens
gcatttttgtctgtgctccctgatcttcaggtcaccaccatgaagttcttagcagtcctggtactcttgggagtttccatctttctggtctctgcccagaatccgacaacagctgctccagctgacacgtatccagctactggtcctgctgatgatgaagcccctgatgctgaaaccactgctgctgcaaccactgcgaccactgctgctcctaccactgcaaccaccgctgcttctaccactgctcgtaaagacattccagttttacccaaatgggttggggatctcccgaatggtagagtgtgtccctgagatggaatcagcttgagtcttctgcaattggtcacaactattcatgcttcctgtgatttcatccaactacttaccttgcctacgatatcccctttatctctaatcagtttattttctttcaaataaaaaataactatgagcaacataaaaaaaaaaaaa

SEQ ID NO: 188 - protein, 90 aa, Homo sapiens
MKFLAVLVLLGVSIFLVSAQNPTTAAPADTYPATGPADDEAPDAETTAAATTATTAAPTTATTAASTTARKDIPVLPKWVGDLPNGRVCP

SEQ ID NO: 189 - DNA, 2213 bp, Homo sapiens
gagcgaacatggcagcgcgttggcggttttggtgtgtctctgtgaccatggtggtggcgctgctcatcgtttgcgacgttccctcagcctctgcccaaagaaagaaggagatggtgttatctgaaaaggttagtcagctgatggaatggactaacaaaagacctgtaataagaatgaatggagacaagttccgtcgccttgtgaaagccccaccgagaaattactccgttatcgtcatgttcactgctctccaactgcatagacagtgtgtcgtttgcaagcaagctgatgaagaattccagatcctggcaaactcctggcgatactccagtgcattcaccaacaggatattttttgccatggtggattttgatgaaggctctgatgtatttcagatgctaaacatgaattcagctccaactttcatcaactttcctgcaaaagggaaacccaaacggggtgatacatatgagttacaggtgcggggtttttcagctgagcagattgcccggtggatcgccgacagaactgatgtcaatattagagtgattagacccccaaattatgctggtccccttatgttgggattgcttttggctgttattggtggacttgtgtatcttcgaagaagtaatatggaatttctctttaataaaactggatgggcttttgcagctttgtgttttgtgcttgctatgacatctggtcaaatgtggaaccatataagaggaccaccatatgcccataagaatccccacacgggacatgtgaattatatccatggaagcagtcaagcccagtttgtagctgaaacacacattgttcttctgtttaatggtggagttaccttaggaatggtgcttttatgtgaagctgctacctctgacatggatattggaaagcgaaagataatgtgtgtggctggtattggacttgttgtattattcttcagttggatgctctctatttttagatctaaatatcatggctacccatacagctttctgatgagttaaaaaggtcccagagatatatagacactggagtactggaaattgaaaaacgaaaatcgtgtgtgtttgaaaagaagaatgcaacttgtatattttgtattacctctttttttcaagtgatttaaatagttaatcatttaaccaaagaagatgtgtagtgccttaacaagcaatcctctgtcaaaatctgaggtatttgaaaataattatcctcttaaccttctcttcccagtgaactttatggaacatttaatttagtacaattaagtatattataaaaattgtaaaactactactttgttttagttagaacaaagctcaaaactactttagttaacttggtcatctgattttatattgccttatccaaagatggggaaagtaagtcctgaccaggtgttcccacatatgcctgttacagataactacattaggaattcattcttagcttcttcatctttgtgtggatgtgtatactttacgcatctttccttttgagtagagaaattatgtgtgtcatgtggtcttctgaaaatggaacaccattcttcagagcacacgtctagccctcagcaagacagttgtttctcctcctccttgcatatttcctactgcgctccagcctgagtgatagagtgagactctgtctcaaaaaaaagtatctctaaatacaggattataatttctgcttgagtatggtgttaactaccttgtatttagaaagatttcagattcattccatctccttagttttcttttaaggtgacccatctgtgataaaaatatagcttagtgctaaaatcagtgtaacttatacatggcctaaaatgtttctacaaattagagtttgtcacttattccatttgtacctaagagaaaaataggctcagttagaaaaggactccctggccaggcgcagtgacttacgcctgtaatctcagcactttgggaggccaaggcaggcagatcacgaggtcaggagttcgagaccatcctggccaacatggtgaaaccccgtctctactaaaaatataaaaattagctgggtgtggtggcaggagcctgtaatcccagctacacaggaggctgaggcacgagaatcacttgaactcaggagatggaggtttcagtgagccgagatcacgccactgcactccagcctggcaacagagcgagactccatctcaaaaaaaaaaaaaa

SEQ ID NO: 190 - protein, 335 aa, Homo sapiens
MAARWRFWCVSVTMVVALLIVCDVPSASAQRKKEMVLSEKVSQLMEWTNKRPVIRMNGDKFRRLVKAPPRNYSVIVMFTALQLHRQCVVCKQADEEFQILANSWRYSSAFTNRIFFAMVDFDEGSDVFQMLNMNSAPTFINFPAKGKPKRGDTYELQVRGFSAEQIARWIADRTDVNIRVIRPPNYAGPLMLGLLLAVIGGLVYLRRSNMEFLFNKTGWAFAALCFVLAMTSGQMWNHIRGPPYAHKNPHTGHVNYIHGSSQAQFVAETHIVLLFNGGVTLGMVLLCEAATSDMDIGKRKIMCVAGIGLVVLFFSWMLSIFRSKYHGYPYSFLMS

SEQ ID NO: 191 - DNA, 1475 bp, Homo sapiens
gagagaagtcagcctggcagagagactctgaaatgagggattagaggtgttcaaggagcaagagcttcagcctgaagacaagggagcagtccctgaagacgcttctactgagaggtctgccatggcctctcttggcctccaacttgtgggctacatcctaggccttctggggcttttgggcacactggttgccatgctgctccccagctggaaaacaagttcttatgtcggtgccagcattgtgacagcagttggcttctccaagggcctctggatggaatgtgccacacacagcacaggcatcacccagtgtgacatctatagcacccttctgggcctgcccgctgacatccaggctgcccaggccatgatggtgacatccagtgcaatctcctccctggcctgcattatctctgtggtgggcatgagatgcacagtcttctgccaggaatcccgagccaaagacagagtggcggtagcaggtggagtctttttcatccttggaggcctcctgggattcattcctgttgcctggaatcttcatgggatcctacgggacttctactcaccactggtgcctgacagcatgaaatttgagattggagaggctctttacttgggcattatttcttccctgttctccctgatagctggaatcatcctctgcttttcctgctcatcccagagaaatcgctccaactactacgatgcctaccaagcccaacctcttgccacaaggagctctccaaggcctggtcaacctcccaaagtcaagagtgagttcaattcctacagcctgacagggtatgtgtgaagaaccaggggccagagctggggggtggctgggtctgtgaaaaacagtggacagcaccccgagggccacaggtgagggacactaccactggatcgtgtcagaaggtgctgctgaggatagactgactttggccattggattgagcaaaggcagaaatgggggctagtgtaacagcatgcaggttgaattgccaaggatgctcgccatgccagcctttctgttttcctcaccttgctgctcccctgccctaagtccccaaccctcaacttgaaaccccattcccttaagccaggactcagaggatccctttgccctctggtttacctgggactccatccccaaacccactaatcacatcccactgactgaccctctgtgatcaaagaccctctctctggctgaggttggctcttagctcattgctggggatgggaaggagaagcagtggcttttgtgggcattgctctaacctacttctcaagcttccctccaaagaaactgattggccctggaacctccatcccactcttgttatgactccacagtgtccagactaatttgtgcatgaactgaaataaaaccatcctacggtatccagggaacagaaagcaggatgcaggatgggaggacaggaaggcagcctgggacatttaaaaaaata

SEQ ID NO: 192 - protein, 230 aa, Homo sapiens
MASLGLQLVGYILGLLGLLGTLVAMLLPSWKTSSYVGASIVTAVGFSKGLWMECATHSTGITQCDIYSTLLGLPADIQAAQAMMVTSSAISSLACIISVVGMRCTVFCQESRAKDRVAVAGGVFFILGGLLGFIPVAWNLHGILRDFYSPLVPDSMKFEIGEALYLGIISSLFSLIAGIILCFSCSSQRNRSNYYDAYQAQPLATRSSPRPGQPPKVKSEFNSYSLTGYV

SEQ ID NO: 193 - DNA, 771 bp, Homo sapiens
ctccactgcaaccacccagagccatggctccccgaggctgcatcgtagctgtctttgccattttctgcatctccaggctcctctgctcacacggagccccagtggcccccatgactccttacctgatgctgtgccagccacacaagagatgtggggacaagttctacgaccccctgcagcactgttgctatgatgatgccgtcgtgcccttggccaggacccagacgtgtggaaactgcaccttcagagtctgctttgagcagtgctgcccctggaccttcatggtgaagctgataaaccagaactgcgactcagcccggacctcggatgacaggctttgtcgcagtgtcagctaatggaacatcaggggaacgatgactcctggattctccttcctgggtgggcctggagaaagaggctggtgttacctgagatctgggatgctgagtggctgtttgggggccagagaaacacacactcaactgcccacttcattctgtgacctgtctgaggcccaccctgcagctgccctgaggaggcccacaggtccccttctagaattctggacagcatgagatgcgtgtgctgatgggggcccagggactctgaaccctcctgatgacccctatggccaacatcaacccggcaccaccccaaggctggctggggaacccttcacccttctgtgagattttccatcatctcaagttctcttctatccaggagcaaagcacaggatcataataaatttatgtactttataaatgaaaa

SEQ ID NO: 194 - protein, 110 aa, Homo sapiens
MAPRGCIVAVFAIFCISRLLCSHGAPVAPMTPYLMLCQPHKRCGDKFYDPLQHCCYDDAVVPLARTQTCGNCTFRVCFEQCCPWTFMVKLINQNCDSARTSDDRLCRSVS

SEQ ID NO: 195 - DNA, 728 bp, Homo sapiens
catttccaacaagagcactggccaagtcagcttcttctgagagagtctctagaagacatgatgctacactcagctttgggtctctgcctcttactcgtcacagtttcttccaaccttgccattgcaataaaaaaggaaaagaggcctcctcagacactctcaagaggatggggagatgacatcacttgggtacaaacttatgaagaaggtctcttttatgctcaaaaaagtaagaagccattaatggttattcatcacctggaggattgtcaatactctcaagcactaaagaaagtatttgcccaaaatgaagaaatacaagaaatggctcagaataagttcatcatgctaaaccttatgcatgaaaccactgataagaatttatcacctgatgggcaatatgtgcctagaatcatgtttgtagacccttctttaacagttagagctgacatagctggaagatactctaacagattgtacacatatgagcctcgggatttacccctattgatagaaaacatgaagaaagcattaagacttattcagtcagagctataagagatgatggaaaaaagccttcacttcaaagaagtcaaatttcatgaagaaaacctctggcacattgacaaatactaaatgtgcaagtatatagattttgtaatattactatttagtttttttaatgtgtttgcaatagtcttattaaaataaatgttttttaaatctga

SEQ ID NO: 196 - protein, 166 aa, Homo sapiens
MMLHSALGLCLLLVTVSSNLAIAIKKEKRPPQTLSRGWGDDITWVQTYEEGLFYAQKSKKPLMVIHHLEDCQYSQALKKVFAQNEEIQEMAQNKFIMLNLMHETTDKNLSPDGQYVPRIMFVDPSLTVRADIAGRYSNRLYTYEPRDLPLLIENMKKALRLIQSEL

SEQ ID NO: 197 - DNA, 2044 bp, Homo sapiens
gggggcgggtgcctggagcacggcgctggggccgcccgcagcgctcactcgctcgcactcagtcgcgggaggcttccccgcgccggccgcgtcccgcccgctccccggcaccagaagttcctctgcgcgtccgacggcgacatgggcgtccccacggccctggaggccggcagctggcgctggggatccctgctcttcgctctcttcctggctgcgtccctaggtccggtggcagccttcaaggtcgccacgccgtattccctgtatgtctgtcccgaggggcagaacgtcaccctcacctgcaggctcttgggccctgtggacaaagggcacgatgtgaccttctacaagacgtggtaccgcagctcgaggggcgaggtgcagacctgctcagagcgccggcccatccgcaacctcacgttccaggaccttcacctgcaccatggaggccaccaggctgccaacaccagccacgacctggctcagcgccacgggctggagtcggcctccgaccaccatggcaacttctccatcaccatgcgcaacctgaccctgctggatagcggcctctactgctgcctggtggtggagatcaggcaccaccactcggagcacagggtccatggtgccatggagctgcaggtgcagacaggcaaagatgcaccatccaactgtgtggtgtacccatcctcctcccaggatagtgaaaacatcacggctgcagccctggctacgggtgcctgcatcgtaggaatcctctgcctccccctcatcctgctcctggtctacaagcaaaggcaggcagcctccaaccgccgtgcccaggagctggtgcggatggacagcaacattcaagggattgaaaaccccggctttgaagcctcaccacctgcccaggggatacccgaggccaaagtcaggcaccccctgtcctatgtggcccagcggcagccttctgagtctgggcggcatctgctttcggagcccagcacccccctgtctcctccaggccccggagacgtcttcttcccatccctggaccctgtccctgactctccaaactttgaggtcatctagcccagctgggggacagtgggctgttgtggctgggtctggggcaggtgcatttgagccagggctggctctgtgagtggcctccttggcctcggccctggttccctccctcctgctctgggctcagatactgtgacatcccagaagcccagcccctcaacccctctggatgctacatggggatgctggacggctcagcccctgttccaaggattttggggtgctgagattctcccctagagacctgaaattcaccagctacagatgccaaatgacttacatcttaagaagtctcagaacgtccagcccttcagcagctctcgttctgagacatgagccttgggatgtggcagcatcagtgggacaagatggacactgggccaccctcccaggcaccagacacagggcacggtggagagacttctcccccgtggccgccttggctcccccgttttgcccgaggctgctcttctgtcagacttcctctttgtaccacagtggctctggggccaggcctgcctgcccactggccatcgccaccttccccagctgcctcctaccagcagtttctctgaagatctgtcaacaggttaagtcaatctggggcttccactgcctgcattccagtccccagagcttggtggtcccgaaacgggaagtacatattggggcatggtggcctccgtgagcaaatggtgtcttgggcaatctgaggccaggacagatgttgccccacccactggagatggtgctgagggaggtgggtggggccttctgggaaggtgagtggagaggggcacctgccccccgccctccccatcccctactcccactgctcagcgcgggccattgcaagggtgccacacaatgtcttgtccaccctgggacacttctgagtatgaagcgggatgctattaaaaactacatggggaaaaaaaaaaaaaaaaaaaaaaaaaaaaaaaaaaaaaga

SEQ ID NO: 198 - protein, 311 aa, Homo sapiens
MGVPTALEAGSWRWGSLLFALFLAASLGPVAAFKVATPYSLYVCPEGQNVTLTCRLLGPVDKGHDVTFYKTWYRSSRGEVQTCSERRPIRNLTFQDLHLHHGGHQAANTSHDLAQRHGLESASDHHGNFSITMRNLTLLDSGLYCCLVVEIRHHHSEHRVHGAMELQVQTGKDAPSNCVVYPSSSQDSENITAAALATGACIVGILCLPLILLLVYKQRQAASNRRAQELVRMDSNIQGIENPGFEASPPAQGIPEAKVRHPLSYVAQRQPSESGRHLLSEPSTPLSPPGPGDVFFPSLDPVPDSPNFEVI

SEQ ID NO: 199 - DNA, 693 bp, Homo sapiens
ctagcctgcgccaaggggtagtgagaccgcgcggcaacagcttgcggctgcggggagctcccgtgggcgctccgctggctgtgcaggcggccatggattccttgcggaaaatgctgatctcagtcgcaatgctgggcgcaggggctggcgtgggctacgcgctcctcgttatcgtgaccccgggagagcggcggaagcaggaaatgctaaaggagatgccactgcaggacccaaggagcagggaggaggcggccaggacccagcagctattgctggccactctgcaggaggcagcgaccacgcaggagaacgtggcctggaggaagaactggatggttggcggcgaaggcggcgccagcgggaggtcaccgtgagaccggacttgcctccgtgggcgccggaccttggcttgggcgcaggaatccgaggcagcctttctccttcgtgggcccagcggagagtccggaccgagataccatgccaggactctccggggtcctgtgagctgccgtcgggtgagcacgtttcccccaaaccctggactgactgctttaaggtccgcaaggcgggccagggccgagacgcgagtcggatgtggtgaactgaaagaaccaataaaatcatgttcctccaaaaaaaaaaaaaaaaaaaaaaaaaaaaaaaaaaaaaaaaaaaaaaaaaaaaaaaaaaaaa

SEQ ID NO: 200 - protein, 93 aa, Homo sapiens [sequence omitted]

SEQ ID NO: 201 - DNA, 2052 bp, Homo sapiens
gacagctgtgtctcgatggagtagactctcagaacagcgcagtttgccctccgctcacgcagagcctctccgtggcttccgcaccttgagcattaggccagttctcctcttctctctaatccatccgtcacctctcctgtcatccgtttccatgccgtgaggtccattcacagaacacatccatggctctcatgctcagtttggttctgagtctcctcaagctgggatcagggcagtggcaggtgtttgggccagacaagcctgtccaggccttggtgggggaggacgcagcattctcctgtttcctgtctcctaagaccaatgcagaggccatggaagtgcggttcttcaggggccagttctctagcgtggtccacctctacagggacgggaaggaccagccatttatgcagatgccacagtatcaaggcaggacaaaactggtgaaggattctattgcggaggggcgcatctctctgaggctggaaaacattactgtgttggatgctggcctctatgggtgcaggattagttcccagtcttactaccagaaggccatctgggagctacaggtgtcagcactgggctcagttcctctcatttccatcacgggatatgttgatagagacatccagctactctgtcagtcctcgggctggttcccccggcccacagcgaagtggaaaggtccacaaggacaggatttgtccacagactccaggacaaacagagacatgcatggcctgtttgatgtggagatctctctgaccgtccaagagaacgccgggagcatatcctgttccatgcggcatgctcatctgagccgagaggtggaatccagggtacagataggagatacctttttcgagcctatatcgtggcacctggctaccaaagtactgggaatactctgctgtggcctattttttggcattgttggactgaagattttcttctccaaattccagtggaaaatccaggcggaactggactggagaagaaagcacggacaggcagaattgagagacgcccggaaacacgcagtggaggtgactctggatccagagacggctcacccgaagctctgcgtttctgatctgaaaactgtaacccatagaaaagctccccaggaggtgcctcactctgagaagagatttacaaggaagagtgtggtggcttctcagagtttccaagcagggaaacattactgggaggtggacggaggacacaataaaaggtggcgcgtgggagtgtgccgggatgatgtggacaggaggaaggagtacgtgactttgtctcccgatcatgggtactgggtcctcagactgaatggagaacatttgtatttcacattaaatccccgttttatcagcgtcttccccaggaccccacctacaaaaataggggtcttcctggactatgagtgtgggaccatctccttcttcaacataaatgaccagtcccttatttataccctgacatgtcggtttgaaggcttattgaggccctacattgagtatccgtcctataatgagcaaaatggaactcccatagtcatctgcccagtcacccaggaatcagagaaagaggcctcttggcaaagggcctctgcaatcccagagacaagcaacagtgagtcctcctcacaggcaaccacgcccttcctccccaggggtgaaatgtaggatgaatcacatcccacattcttctttagggatattaaggtctctctcccagatccaaagtcccgcagcagccggccaaggtggcttccagatgaagggggactggcctgtccacatgggagtcaggtgtcatggctgccctgagctgggagggaagaaggctgacattacatttagtttgctctcactccatctggctaagtgatcttgaaataccacctctcaggtgaagaaccgtcaggaattcccatctcacaggctgtggtgtagattaagtagacaaggaatgtgaataatgcttagatcttattgatgacagagtgtatcctaatggtttgttcattatattacactttcagtaaaaaaa

SEQ ID NO: 202 - protein, 500 aa, Homo sapiens
MALMLSLVLSLLKLGSGQWQVFGPDKPVQALVGEDAAFSCFLSPKTNAEAMEVRFFRGQFSSVVHLYRDGKDQPFMQMPQYQGRTKLVKDSIAEGRISLRLENITVLDAGLYGCRISSQSYYQKAIWELQVSALGSVPLISITGYVDRDIQLLCQSSGWFPRPTAKWKGPQGQDLSTDSRTNRDMHGLFDVEISLTVQENAGSISCSMRHAHLSREVESRVQIGDTFFEPISWHLATKVLGILCCGLFFGIVGLKIFFSKFQWKIQAELDWRRKHGQAELRDARKHAVEVTLDPETAHPKLCVSDLKTVTHRKAPQEVPHSEKRFTRKSVVASQSFQAGKHYWEVDGGHNKRWRVGVCRDDVDRRKEYVTLSPDHGYWVLRLNGEHLYFTLNPRFISVFPRTPPTKIGVFLDYECGTISFFNINDQSLIYTLTCRFEGLLRPYIEYPSYNEQNGTPIVICPVTQESEKEASWQRASAIPETSNSESSSQATTPFLPRGEM

SEQ ID NO: 203 - DNA, 689 bp, Homo sapiens
tgcggcgcagtgtagacctgggaggatgggcggcctgctgctggctgcttttctggctttggtctcggtgcccagggcccaggccgtgtggttgggaagactggaccctgagcagcttcttgggccctggtacgtgcttgcggtggcctcccgggaaaagggctttgccatggagaaggacatgaagaacgtcgtgggggtggtggtgaccctcactccagaaaacaacctgcggacgctgtcctctcagcacgggctgggagggtgtgaccagagtgtcatggacctgataaagcgaaactccggatgggtgtttgagaatccctcaataggcgtgctggagctctgggtgctggccaccaacttcagagactatgccatcatcttcactcagctggagttcggggacgagcccttcaacaccgtggagctgtacagtctgacggagacagccagccaggaggccatggggctcttcaccaagtggagcaggagcctgggcttcctgtcacagtagcaggcccagctgcagaaggacctcacctgtgctcacaagatccttctgtgagtgctgcgtccccagtagggatggcgcccacagggtcctgtgacctcggccagtgtccacccacctcgctcagcggctcccggggcccagcaccagctcagaataaagcgattccacagca

SEQ ID NO: 204 - protein, 163 aa, Homo sapiens
MGGLLLAAFLALVSVPRAQAVWLGRLDPEQLLGPWYVLAVASREKGFAMEKDMKNVVGVVVTLTPENNLRTLSSQHGLGGCDQSVMDLIKRNSGWVFENPSIGVLELWVLATNFRDYAIIFTQLEFGDEPFNTVELYSLTETASQEAMGLFTKWSRSLGFLSQ

SEQ ID NO: 205 - DNA, 739 bp, Homo sapiens
gacgcccagtgacctgccgaggtcggcagcacagagctctggagatgaagaccctgttcctgggtgtcacgctcggcctggccgctgccctgtccttcaccctggaggaggaggatatcacagggacctggtacgtgaaggccatggtggtcgataaggactttccggaggacaggaggcccaggaaggtgtccccagtgaaggtgacagccctgggcggtgggaagttggaagccacgttcaccttcatgagggaggatcggtgcatccagaagaaaatcctgatgcggaagacggaggagcctggcaaatacagcgcctatgggggcaggaagctcatgtacctgcaggagctgcccaggagggaccactacatcttttactgcaaagaccagcaccatgggggcctgctccacatgggaaagcttgtgggtaggaattctgataccaaccgggaggccctggaagaatttaagaaattggtgcagcgcaagggactctcggaggaggacattttcacgcccctgcagacgggaagctgcgttcccgaacactaggcagcccccgggtctgcacctccagagcccaccctaccaccagacacagagcccggaccacctggacctaccctccagccatgacccttccctgctcccacccacctgactccaaataaagtccttttcccccaaaaaaaaaaaaaaaaaaaaaaaaaaaaaaaaaaaaaaaaaaaaaaaaa

SEQ ID NO: 206 - protein, 170 aa, Homo sapiens
MKTLFLGVTLGLAAALSFTLEEEDITGTWYVKAMVVDKDFPEDRRPRKVSPVKVTALGGGKLEATFTFMREDRCIQKKILMRKTEEPGKYSAYGGRKLMYLQELPRRDHYIFYCKDQHHGGLLHMGKLVGRNSDTNREALEEFKKLVQRKGLSEEDIFTPLQTGSCVPEH

SEQ ID NO: 207 - DNA, 1204 bp, Homo sapiens
gttccgcagatgcagaggttgaggtggctgcgggactggaagtcatcgggcagaggtctcacagcagccaaggaacctggggcccgctcctcccccctccaggccatgaggattctgcagttaatcctgcttgctctggcaacagggcttgtagggggagagaccaggatcatcaaggggttcgagtgcaagcctcactcccagccctggcaggcagccctgttcgagaagacgcggctactctgtggggcgacgctcatcgcccccagatggctcctgacagcagcccactgcctcaagccccgctacatagttcacctggggcagcacaacctccagaaggaggagggctgtgagcagacccggacagccactgagtccttcccccaccccggcttcaacaacagcctccccaacaaagaccaccgcaatgacatcatgctggtgaagatggcatcgccagtctccatcacctgggctgtgcgacccctcaccctctcctcacgctgtgtcactgctggcaccagctgcctcatttccggctggggcagcacgtccagcccccagttacgcctgcctcacaccttgcgatgcgccaacatcaccatcattgagcaccagaagtgtgagaacgcctaccccggcaacatcacagacaccatggtgtgtgccagcgtgcaggaagggggcaaggactcctgccagggtgactccgggggccctctggtctgtaaccagtctcttcaaggcattatctcctggggccaggatccgtgtgcgatcacccgaaagcctggtgtctacacgaaagtctgcaaatatgtggactggatccaggagacgatgaagaacaattagactggacccacccaccacagcccatcaccctccatttccacttggtgtttggttcctgttcactctgttaataagaaaccctaagccaagaccctctacgaacattctttgggcctcctggactacaggagatgctgtcacttaataatcaacctggggttcgaaatcagtgagacctggattcaaattctgccttgaaatattgtgactctgggaatgacaacacctggtttgttctctgttgtatccccagccccaaagacagctcctggccatatatcaaggtttcaataaatatttgctaaatgaaaaaaaaaaaaaaaaaaaaaaaaaaaaaaaaaaaaaa

SEQ ID NO: 208 - protein, 250 aa, Homo sapiens
MRILQLILLALATGLVGGETRIIKGFECKPHSQPWQAALFEKTRLLCGATLIAPRWLLTAAHCLKPRYIVHLGQHNLQKEEGCEQTRTATESFPHPGFNNSLPNKDHRNDIMLVKMASPVSITWAVRPLTLSSRCVTAGTSCLISGWGSTSSPQLRLPHTLRCANITIIEHQKCENAYPGNITDTMVCASVQEGGKDSCQGDSGGPLVCNQSLQGIISWGQDPCAITRKPGVYTKVCKYVDWIQETMKNN

SEQ ID NO: 209 - DNA, 1485 bp, Homo sapiens
gcggccacacgcagctagccggagcccggaccaggcgcctgtgcctcctcctcgtccctcgccgcgtccgcgaagcctggagccggcgggagccccgcgctcgccatgtcgggcgagctcagcaacaggttccaaggagggaaggcgttcggcttgctcaaagcccggcaggagaggaggctggccgagatcaaccgggagtttctgtgtgaccagaagtacagtgatgaagagaaccttccagaaaagctcacagccttcaaagagaagtacatggagtttgacctgaacaatgaaggcgagattgacctgatgtctttaaagaggatgatggagaagcttggtgtccccaagacccacctggagatgaagaagatgatctcagaggtgacaggaggggtcagtgacactatatcctaccgagactttgtgaacatgatgctggggaaacggtcggctgtcctcaagttagtcatgatgtttgaaggaaaagccaacgagagcagccccaagccagttggcccccctccagagagagacattgctagcctgccctgaggaccccgcctggactccccagccttcccaccccatacctccctcccgatcttgctgcccttcttgacacactgtgatctctctctctctcatttgtttggtcattgagggtttgtttgtgttttcatcaatgtctttgtaaagcacaaattatctgccttaaaggggctctgggtcggggaatcctgagccttgggtcccctccctctcttcttccctccttccccgctccctgtgcagaagggctgatatcaaaccaaaaactagagggggcagggccagggcagggaggcttccagcctgtgttcccctcacttggaggaaccagcactctccatcctttcagaaagtctccaagccaagttcaggctcactgacctggctctgacgaggaccccaggccactctgagaagaccttggagtagggacaaggctgcagggcctctttcgggtttccttggacagtgccatggttccagtgctctggtgtcacccaggacacagccactcggggccccgctgccccagctgatccccactcattccacacctcttctcatcctcagtgatgtgaaggtgggaaggaaaggagcttggcattgggagcccttcaagaaggtaccagaaggaaccctccagtcctgctctctggccacacctgtgcaggcagctgagaggcagcgtgcagccctactgtcccttactggggcagcagagggcttcggaggcagaagtgaggcctggggtttggggggaaaggtcagctcagtgctgttccaccttttagggaggatactgaggggaccaggatgggagaatgaggagtaaaatgctcacggcaaagtcagcagcactggtaagccaagactgagaaatacaaggttgcttgtctgaccccaatctgcttgaaaaaaaaaaaaaaaaaa

SEQ ID NO: 210 - protein, 150 aa, Homo sapiens
MSGELSNRFQGGKAFGLLKARQERRLAEINREFLCDQKYSDEENLPEKLTAFKEKYMEFDLNNEGEIDLMSLKRMMEKLGVPKTHLEMKKMISEVTGGVSDTISYRDFVNMMLGKRSAVLKLVMMFEGKANESSPKPVGPPPERDIASLP

SEQ ID NO: 211 - DNA, 636 bp, Homo sapiens
ctgggatcagccactgcagctccctgagcactctctacagagacgcggaccccagacatgaggaggctcctcctggtcaccagcctggtggttgtgctgctgtgggaggcaggtgcagtcccagcacccaaggtccctatcaagatgcaagtcaaacactggccctcagagcaggacccagagaaggcctggggcgcccgtgtggtggagcctccggagaaggacgaccagctggtggtgctgttccctgtccagaagccgaaactcttgaccaccgaggagaagccacgaggtcagggcaggggccccatccttccaggcaccaaggcctggatggagaccgaggacaccctgggccgtgtcctgagtcccgagcccgaccatgacagcctgtaccaccctccgcctgaggaggaccagggcgaggagaggccccggttgtgggtgatgccaaatcaccaggtgctcctgggaccggaggaagaccaagaccacatctaccacccccagtagggctccaggggccatcactgcccccgccctgtcccaaggcccaggctgttgggactgggaccctccctaccctgccccagctagacaaataaaccccagcaggcaaaaaaaaaaaaaaaaaaa

SEQ ID NO: 212 - protein, 151 aa, Homo sapiens
MRRLLLVTSLVVVLLWEAGAVPAPKVPIKMQVKHWPSEQDPEKAWGARVVEPPEKDDQLVVLFPVQKPKLLTTEEKPRGQGRGPILPGTKAWMETEDTLGRVLSPEPDHDSLYHPPPEEDQGEERPRLWVMPNHQVLLGPEEDQDHIYHPQ

SEQ ID NO: 213 - DNA, 2014 bp, Homo sapiens
caggcagaagcgaacaaagacccagcaagagaaggcagaggctaagacccatcccgtatctgctctcctgaaataattctggagtcatgcctgaaatgccagaggacatggagcaggaggaagttaacatccctaataggagggttctggttactggtgccactgggcttcttggcagagctgtacacaaagaatttcagcagaataattggcatgcagttggctgtggtttcagaagagcaagaccaaaatttgaacaggttaatctgttggattctaatgcagttcatcacatcattcatgattttcagccccatgttatagtacattgtgcagcagagagaagaccagatgttgtagaaaatcagccagatgctgcctctcaacttaatgtggatgcttctgggaatttagcaaaggaagcagctgctgttggagcatttctcatctacattagctcagattatgtatttgatggaacaaatccaccttacagagaggaagacataccagctcccctaaatttgtatggcaaaacaaaattagatggagaaaaggctgtcctggagaacaatctaggagctgctgttttgaggattcctattctgtatggggaagttgaaaagctcgaagaaagtgctgtgactgttatgtttgataaagtgcagttcagcaacaagtcagcaaacatggatcactggcagcagaggttccccacacatgtcaaagatgtggccactgtgtgccggcagctagcagagaagagaatgctggatccatcaattaagggaacctttcactggtctggcaatgaacagatgactaagtatgaaatggcatgtgcaattgcagatgccttcaacctccccagcagtcacttaagacctattactgacagccctgtcctaggagcacaacgtccgagaaatgctcagcttgactgctccaaattggagaccttgggcattggccaacgaacaccatttcgaattggaatcaaagaatcactttggcctttcctcattgacaagagatggagacaaacggtctttcattagtttatttgtgttgggttctttttttttttaaatgaaaagtatagtatgtggcactttttaaagaacaaaggaaatagttttgtatgagtactttaattgtgactcttaggatctttcaggtaaatgatgctcttgcactagtgaaattgtctaaagaaactaaagggcagtcatgccctgtttgcagtaatttttctttttatcattttgtttgtcctggctaaacttggagtttgagtatagtaaattatgatccttaaatatttgagagtcaggatgaagcagatctgctgtagacttttcagatgaaattgttcattctcgtaacctccatattttcaggatttttgaagctgttgaccttttcatgttgattattttaaattgtgtgaaatagtataaaaatcattggtgttcattatttgctttgcctgagctcagatcaaaatgtttgaagaaaggaactttatttttgcaagttacgtacagtttttatgcttgagatatttcaacatgttatgtatattggaacttctacagcttgatgcctcctgcttttatagcagtttatggggagcacttgaaagagcgtgtgtacatgtattttttttctaggcaaacattgaatgcaaacgtgtatttttttaatataaatatataactgtccttttcatcccatgttgccgctaagtgatatttcatatgtgtggttatactcataataatgggccttgtaagtcttttcaccattcatgaataataataaatatgtactgctggcatgtaatgcttagttttcttgtatttacttctttttttaaatgtaaggaccaaacttctaaactaattgttcttttgttgctttaatttttaaaaattacattcttctgatgtaacatgtgatacatacaaaagaatatagtttaatatgtattgaaataaaacacaataaaatt

SEQ ID NO: 214 - protein, 323 aa, Homo sapiens
MPEMPEDMEQEEVNIPNRRVLVTGATGLLGRAVHKEFQQNNWHAVGCGFRRARPKFEQVNLLDSNAVHHIIHDFQPHVIVHCAAERRPDVVENQPDAASQLNVDASGNLAKEAAAVGAFLIYISSDYVFDGTNPPYREEDIPAPLNLYGKTKLDGEKAVLENNLGAAVLRIPILYGEVEKLEESAVTVMFDKVQFSNKSANMDHWQQRFPTHVKDVATVCRQLAEKRMLDPSIKGTFHWSGNEQMTKYEMACAIADAFNLPSSHLRPITDSPVLGAQRPRNAQLDCSKLETLGIGQRTPFRIGIKESLWPFLIDKRWRQTVFH

SEQ ID NO: 215 - DNA, 2065 bp, Homo sapiens
gtgaatgtgagggtttgatgactttcagatgtctaggaaccagagtgggtgcaggggccccaggcagggctgattcttgggcggaggagagtagggtaaagggttctgcatgagctccttaaaggacaaaggtaacagagccagcgagagagctcgaggggagactttgacttcaagccacagaattggtggaagtgtgcgcgccgccgccgccgtcgctcctgcagcgctgtcgacctagccgctagcatcttcccgagcaccgggatcccggggtaggaggcgacgcgggcgagcaccagcgccagccggctgcggctgcccacacggctcaccatgggctccgggcgccgggcgctgtccgcggtgccggccgtgctgctggtcctcacgctgccggggctgcccgtctgggcacagaacgacacggagcccatcgtgctggagggcaagtgtctggtggtgtgcgactcgaacccggccacggactccaagggctcctcttcctccccgctggggatatcggtccgggcggccaactccaaggtcgccttctcggcggtgcggagcaccaaccacgagccatccgagatgagcaacaagacgcgcatcatttacttcgatcagatcctggtgaatgtgggtaattttttcacattggagtctgtctttgtagcaccaagaaaaggaatttacagtttcagttttcacgtgattaaagtctaccagagccaaactatccaggttaacttgatgttaaatggaaaaccagtaatatctgcctttgcgggggacaaagatgttactcgtgaagctgccacgaatggtgtcctgctctacctagataaagaggataaggtttacctaaaactggagaaaggtaatttggttggaggctggcagtattccacgttttctggctttctggtgttccccctataggattcaatttctccatgatgttcatccaggtgagggatgacccactcctgagttattggaagatcattttttcatcattggattgatgtcttttattggtttctcatgggtggatatggattctaaggattctagcctgtctgaaccaatacaaaatttcacagattatttgtgtgtgtctgtttcagtatatttggattgggactctaagcagataatacctatgcttaaatgtaacagtcaaaagctgtctgcaagacttattctgaatttcatttcctgggattactgaattagttacagatgtggaattttatttgtttagttttaaaagactggcaaccaggtctaaggattagaaaactctaaagttctgacttcaatcaacggttagtgtgatactgccaaagaactgtatactgtgttaatatattgattatatttgtttttattcctttggaattagtttgtttggttcttgtaaaaaacttggattttttttttcagtaactggtattatgttttctcttaaaataaggtaatgaatggcttgcccacaaatttaccttgactacgatatcatcgacatgacttctctcaaaaaaaaagaatgcttcatagttgtattttaattgtatatgtgaaagagtcatattttccaagttatattttctaagaagaagaatagatcataaatctgacaaggaaaaagttgcttacccaaaatctaagtgctcaatccctgagcctcagcaaaacagctcccctccgagggaaatcttatactttattgctcaactttaattaaaatgattgataataaccactttattaaaaacctaaggttttttttttttccgtagacatgaccactttattaactggtggtgggatgctgttgtttctaattatacctatttttcaaggcttctgttgtatttgaagtatcatctggttttgccttaactctttaaattgtatatatttatctgtttagctaatattaaattcaaatatcccatatctaaatttagtgcaatatcttgtcttttgtataggtcatatgaattcataaaattatttatgtctgttatagaataaagattaatatatgttaaaaaaa

SEQ ID NO: 216 - protein, 201 aa, Homo sapiens
MGSGRRALSAVPAVLLVLTLPGLPVWAQNDTEPIVLEGKCLVVCDSNPATDSKGSSSSPLGISVRAANSKVAFSAVRSTNHEPSEMSNKTRIIYFDQILVNVGNFFTLESVFVAPRKGIYSFSFHVIKVYQSQTIQVNLMLNGKPVISAFAGDKDVTREAATNGVLLYLDKEDKVYLKLEKGNLVGGWQYSTFSGFLVFPL

SEQ ID NO: 217 - DNA, 3939 bp, Homo sapiens
cggcaaccagccgccgccaccaccgctgccactgccgccctgccggggccatgttcgctctgggcttgcccttcttggtgctcttggtggcctcggtcgagagccatctgggggttctggggcccaagaacgtctcgcagaaagacgccgagtttgagcgcacctacgtggacgaggtcaacagcgagctggtcaacatctacaccttcaaccatactgtgacccgcaacaggacagagggcgtgcgtgtgtctgtgaacgtcctgaacaagcagaagggggcgccgttgctgtttgtggtccgccagaaggaggctgtggtgtccttccaggtgcccctaatcctgcgagggatgtttcagcgcaagtacctctaccaaaaagtggaacgaaccctgtgtcagccccccaccaagaatgagtcggagattcagttcttctacgtggatgtgtccaccctgtcaccagtcaacaccacataccagctccgggtcagccgcatggacgattttgtgctcaggactggggagcagttcagcttcaataccacagcagcacagccccagtacttcaagtatgagttccctgaaggcgtggactcggtaattgtcaaggtgacctccaacaaggccttcccctgctcagtcatctccattcaggatgtgctgtgtcctgtctatgacctggacaacaacgtagccttcatcggcatgtaccagacgatgaccaagaaggcggccatcaccgtacagcgcaaagacttccccagcaacagcttttatgtggtggtggtggtgaagaccgaagaccaagcctgcgggggctccctgcctttctaccccttcgcagaagatgaaccggtcgatcaagggcaccgccagaaaaccctgtcagtgctggtgtctcaagcagtcacgtctgaggcatacgtcagtgggatgctcttttgcctgggtatatttctctccttttacctgctgaccgtcctcctggcctgctgggagaactggaggcagaagaagaagaccctgctggtggccattgaccgagcctgcccagaaagcggtcaccctcgagtcctggctgattcttttcctggcagttccccttatgagggttacaactatggctcctttgagaatgtttctggatctaccgatggtctggttgacagcgctggcactggggacctctcttacggttaccagggccgctcctttgaacctgtaggtactcggccccgagtggactccatgagctctgtggaggaggatgactacgacacattgaccgacatcgattccgacaagaatgtcattcgcaccaagcaatacctctatgtggctgacctggcacggaaggacaagcgtgttctgcggaaaaagtaccagatctacttctggaacattgccaccattgctgtcttctatgcccttcctgtggtgcagctggtgatcacctaccagacggtggtgaatgtcacagggaatcaggacatctgctactacaacttcctctgcgcccacccactgggcaatctcagcgccttcaacaacatcctcagcaacctggggtacatcctgctggggctgcttttcctgctcatcatcctgcaacgggagatcaaccacaaccgggccctgctgcgcaatgacctctgtgccctggaatgtgggatccccaaacactttgggcttttctacgccatgggcacagccctgatgatggaggggctgctcagtgcttgctatcatgtgtgccccaactataccaatttccagtttgacacatcgttcatgtacatgatcgccggactctgcatgctgaagctctaccagaagcggcacccggacatcaacgccagcgcctacagtgcctacgcctgcctggccattgtcatcttcttctctgtgctgggcgtggtctttggcaaagggaacacggcgttctggatcgtcttctccatcattcacatcatcgccaccctgctcctcagcacgcagctctattacatgggccggtggaaactggactcggggatcttccgccgcatcctccacgtgctctacacagactgcatccggcagtgcagcgggccgctctacgtggaccgcatggtgctgctggtcatgggcaacgtcatcaactggtcgctggctgcctatgggcttatcatgcgccccaatgatttcgcttcctacttgttggccattggcatctgcaacctgctcctttacttcgccttctacatcatcatgaagctccggagtggggagaggatcaagctcatccccctgctctgcatcgtttgcacctccgtggtctggggcttcgcgctcttcttcttcttccagggactcagcacctggcagaaaacccctgcagagtcgagggagcacaaccgggactgcatcctcctcgacttctttgacgaccacgacatctggcacttcctctcctccatcgccatgttcgggtccttcctggtgttgctgacactggatgacgacctggatactgtgcagcgggacaagatctatgtcttctagcaggagctgggcccttcgcttcacctcaaggggccctgagctcctttgtgtcatagaccggtcactctgtcgtgctgtggggatgagtcccagcaccgctgcccagcactggatggcagcaggacagccaggtctagcttaggcttggcctgggacagccatggggtggcatggaaccttgcagctgccctctgccgaggagcaggcctgctcccctggaacccccagatgttggccaaattgctgctttcttctcagtgttggggccttccatgggcccctgtcctttggctctccatttgtccctttgcaagaggaaggatggaagggacaccctccccatttcatgccttgcattttgcccgtcctcctccccacaatgccccagcctgggacctaaggcctctttttcctcccatactcccactccagggcctagtctggggcctgaatctctgtcctgtatcagggccccagttctctttgggctgtccctggctgccatcactgcccattccagtcagccaggatggatgggggtatgagattttgggggttggccagctggtgccagacttttggtgctaaggcctgcaaggggcctggggcagtgcgtattctcttccctctgacctgtgctcagggctggctctttagcaatgcgctcagcccaatttgagaaccgccttctgattcaagaggctgaattcagaggtcacctcttcatcccatcagctcccagactgatgccagcaccaggactggagggagaagcgcctcaccccttcccttccttctttccaggcccttagtcttgccaaaccccagctggtggcctttcagtgccattgacactgcccaagaatgtccaggggcaaaggagggatgatacagagttcagcccgttctgcctccacagctgtgggcaccccagtgcctaccttagaaaggggcttcaggaagggatgtgctgtttccctctacgtgcccagtcctagcctcgctctaggacccagggctggcttctaagtttccgtccagtcttcaggcaagttctgtgttagtcatgcacacacatacctatgaaaccttggagtttacaaagaattgccccagctctgggcaccctggccaccctggtccttggatccccttcgtcccacctggtccaccccagatgctgaggatgggggagctcaggcggggcctctgctttggggatgggaatgtgtttttctcccaaacttgtttttatagctctgcttgaagggctgggagatgaggtgggtctggatcttttctcagagcgtctccatgctatggttgcatttccgttttctatgaatgaatttgcattcaataaacaaccagactcaaaaaaaaaaaaaaa

SEQ ID NO: 218 - protein, 832 aa, Homo sapiens
MFALGLPFLVLLVASVESHLGVLGPKNVSQKDAEFERTYVDEVNSELVNIYTFNHTVTRNRTEGVRVSVNVLNKQKGAPLLFVVRQKEAVVSFQVPLILRGMFQRKYLYQKVERTLCQPPTKNESEIQFFYVDVSTLSPVNTTYQLRVSRMDDFVLRTGEQFSFNTTAAQPQYFKYEFPEGVDSVIVKVTSNKAFPCSVISIQDVLCPVYDLDNNVAFIGMYQTMTKKAAITVQRKDFPSNSFYVVVVVKTEDQACGGSLPFYPFAEDEPVDQGHRQKTLSVLVSQAVTSEAYVSGMLFCLGIFLSFYLLTVLLACWENWRQKKKTLLVAIDRACPESGHPRVLADSFPGSSPYEGYNYGSFENVSGSTDGLVDSAGTGDLSYGYQGRSFEPVGTRPRVDSMSSVEEDDYDTLTDIDSDKNVIRTKQYLYVADLARKDKRVLRKKYQIYFWNIATIAVFYALPVVQLVITYQTVVNVTGNQDICYYNFLCAHPLGNLSAFNNILSNLGYILLGLLFLLIILQREINHNRALLRNDLCALECGIPKHFGLFYAMGTALMMEGLLSACYHVCPNYTNFQFDTSFMYMIAGLCMLKLYQKRHPDINASAYSAYACLAIVIFFSVLGVVFGKGNTAFWIVFSIIHIIATLLLSTQLYYMGRWKLDSGIFRRILHVLYTDCIRQCSGPLYVDRMVLLVMGNVINWSLAAYGLIMRPNDFASYLLAIGICNLLLYFAFYIIMKLRSGERIKLIPLLCIVCTSVVWGFALFFFFQGLSTWQKTPAESREHNRDCILLDFFDDHDIWHFLSSIAMFGSFLVLLTLDDDLDTVQRDKIYVF

SEQ ID NO: 219 - DNA, 1073 bp, Homo sapiens
aatttttcaccagagtaaacttgagaaaccaactggaccttgagtattgtacattttgcctcgtggacccaaaggtagcaatctgaaacatgaggagtacgattctactgttttgtcttctaggatcaactcggtcattaccacagctcaaacctgctttgggactccctcccacaaaactggctccggatcagggaacactaccaaaccaacagcagtcaaatcaggtctttccttctttaagtctgataccattaacacagatgctcacactggggccagatctgcatctgttaaatcctgctgcaggaatgacacctggtacccagacccacccattgaccctgggagggttgaatgtacaacagcaactgcacccacatgtgttaccaatttttgtcacacaacttggagcccagggcactatcctaagctcagaggaattgccacaaatcttcacgagcctcatcatccattccttgttcccgggaggcatcctgcccaccagtcaggcaggggctaatccagatgtccaggatggaagccttccagcaggaggagcaggtgtaaatcctgccacccagggaaccccagcaggccgcctcccaactcccagtggcacagatgacgactttgcagtgaccacccctgcaggcatccaaaggagcacacatgccatcgaggaagccaccacagaatcagcaaatggaattcagtaagctgtttcaaattttttcaactaagctgcctcgaatttggtgatacatgtgaatctttatcattgattatattatggaatagattgagacacattggatagtcttagaagaaattaattcttaatttacctgaaaatattcttgaaatttcagaaaatatgttctatgtagagaatcccaacttttaaaaacaataattcaatggataaatctgtctttgaaatataacattatgctgcctggatgatatgcatattaaaacatatttggaaaactggaaaaaaaaaaaaaaaaaaaaaaaaaaaaaaaaaaaaaaaaaaaaaaaaaaaaaaaaaaaaaaaaaaaaaaaaaaaa

SEQ ID NO: 220 - protein, 209 aa, Homo sapiens
MRSTILLFCLLGSTRSLPQLKPALGLPPTKLAPDQGTLPNQQQSNQVFPSLSLIPLTQMLTLGPDLHLLNPAAGMTPGTQTHPLTLGGLNVQQQLHPHVLPIFVTQLGAQGTILSSEELPQIFTSLIIHSLFPGGILPTSQAGANPDVQDGSLPAGGAGVNPATQGTPAGRLPTPSGTDDDFAVTTPAGIQRSTHAIEEATTESANGIQ

SEQ ID NO: 221 - DNA, 2668 bp, Homo sapiens
gactttgcttgaatgtttacattttctgctcgctgtcctacatatcacaatatagtgttcacgttttgttaaaactttggggtgtcaggagttgagcttgctcagcaagccagcatggctaggatgagctttgttatagcagcttgccaattggtgctgggcctactaatgacttcattaaccgagtcttccatacagaatagtgagtgtccacaactttgcgtatgtgaaattcgtccctggtttaccccacagtcaacttacagagaagccaccactgttgattgcaatgacctccgcttaacaaggattcccagtaacctctctagtgacacacaagtgcttctcttacagagcaataacatcgcgaagactgtggatgagctgcagcagcttttcaacttgactgaactagatttctcccaaaacaactttactaacattaaggaggtcgggctggcaaacctaacccagctcacaacgctgcatttggaggaaaatcagattaccgagatgactgattactgtctacaagacctcagcaaccttcaagaactctacatcaaccacaaccaaattagcactatttctgctcatgcttttgcaggcttaaaaaatctattaaggctccacctgaactccaacaaattgaaagttattgatagtcgctggtttgattctacacccaacctggaaattctcatgatcggagaaaaccctgtgattggaattctggatatgaacttcaaacccctcgcaaatttgagaagcttagttttggcaggaatgtatctcactgatattcctggaaatgctttggtgggtctggatagccttgagagcctgtctttttatgataacaaactggttaaagtccctcaacttgccctgcaaaaagttccaaatttgaaattcttagacctcaacaaaaaccccattcacaaaatccaagaaggggacttcaaaaatatgcttcggttaaaagaactgggaatcaacaatatgggcgagctcgtttctgtcgaccgctatgccctggataacttgcctgaactcacaaagctggaagccaccaataaccctaaactctcttacatccaccgcttggctttccgaagtgtccctgctctggaaagcttgatgctgaacaacaatgccttgaatgccatttaccaaaagacagtcgaatccctccccaatctgcgtgagatcagtatccatagcaatcccctcaggtgtgactgtgtgatccactggattaactccaacaaaaccaacatccgcttcatggagcccctgtccatgttctgtgccatgccgcccgaatataaagggcaccaggtgaaggaagttttaatccaggattcgagtgaacagtgcctcccaatgatatctcacgacagcttcccaaatcgtttaaacgtggatatcggcacgacggttttcctagactgtcgagccatggctgagccagaacctgaaatttactgggtcactcccattggaaataagataactgtggaaaccctttcagataaatacaagctaagtagcgaaggtaccttggaaatatctaacatacaaattgaagactcaggaagatacacatgtgttgcccagaatgtccaaggggcagacactcgggtggcaacaattaaggttaacgggacccttctggatggtacccaggtgctaaaaatatacgtcaagcagacagaatcccattccatcttagtgtcctggaaagttaattccaatgtcatgacgtcaaacttaaaatggtcgtctgccaccatgaagattgataaccctcacataacatatactgccagggtcccagtcgatgtccatgaatacaacctaacgcatctgcagccttccacagattatgaagtgtgtctcacagtgtccaatattcatcagcagactcaaaagtcatgcgtaaatgtcacaaccaaaaatgccgccttcgcagtggacatctctgatcaagaaaccagtacagcccttgctgcagtaatggggtctatgtttgccgtcattagccttgcgtccattgctgtgtactttgccaaaagatttaagagaaaaaactaccaccactcattaaaaaagtatatgcaaaaaacctcttcaatcccactaaatgagctgtacccaccactcattaacctctgggaaggtgacagcgagaaagacaaagatggttctgcagacaccaagccaacccaggtcgacacatccagaagctattacatgtggtaactcagaggatattttgcttctggtagtaaggagcacaaagacgtttttgctttattctgcaaaagtgaacaagttgaagacttttgtatttttgactttgctagtttgtggcagagtggagaggacgggtggatatttcaaatttttttagtatagcgtatcgcaagggtttgacacggctgccagcgactctaggcttccagtctgtgtttggtttttattcttatcattattatgattgttattatattattattttattttagttgttgtgctaaactcaataatgctgttctaactacagtgctcaataaaatgattaatgacaggaaaaaaaaaaaaaaaaaaaaaaaaaaaaaaaaaaaaaaaaaaaaaaaaaaaaaaaaaaaaaaaaaaaaaaaaa

SEQ ID NO: 222 - protein, 716 aa, Homo sapiens
MARMSFVIAACQLVLGLLMTSLTESSIQNSECPQLCVCEIRPWFTPQSTYREATTVDCNDLRLTRIPSNLSSDTQVLLLQSNNIAKTVDELQQLFNLTELDFSQNNFTNIKEVGLANLTQLTTLHLEENQITEMTDYCLQDLSNLQELYINHNQISTISAHAFAGLKNLLRLHLNSNKLKVIDSRWFDSTPNLEILMIGENPVIGILDMNFKPLANLRSLVLAGMYLTDIPGNALVGLDSLESLSFYDNKLVKVPQLALQKVPNLKFLDLNKNPIHKIQEGDFKNMLRLKELGINNMGELVSVDRYALDNLPELTKLEATNNPKLSYIHRLAFRSVPALESLMLNNNALNAIYQKTVESLPNLREISIHSNPLRCDCVIHWINSNKTNIRFMEPLSMFCAMPPEYKGHQVKEVLIQDSSEQCLPMISHDSFPNRLNVDIGTTVFLDCRAMAEPEPEIYWVTPIGNKITVETLSDKYKLSSEGTLEISNIQIEDSGRYTCVAQNVQGADTRVATIKVNGTLLDGTQVLKIYVKQTESHSILVSWKVNSNVMTSNLKWSSATMKIDNPHITYTARVPVDVHEYNLTHLQPSTDYEVCLTVSNIHQQTQKSCVNVTTKNAAFAVDISDQETSTALAAVMGSMFAVISLASIAVYFAKRFKRKNYHHSLKKYMQKTSSIPLNELYPPLINLWEGDSEKDKDGSADTKPTQVDTSRSYYMW

SEQ ID NO: 223 - DNA, 1743 bp, Homo sapiens
caaccatgcaaggacagggcaggagaagaggaacctgcaaagacatattttgttccaaaatggcatcttacctttatggagtactctttgctgttggcctctgtgctccaatctactgtgtgtccccggccaatgcccccagtgcatacccccgcccttcctccacaaagagcacccctgcctcacaggtgtattccctcaacaccgactttgccttccgcctataccgcaggctggttttggagaccccgagtcagaacatcttcttctcccctgtgagtgtctccacttccctggccatgctctcccttggggcccactcagtcaccaagacccagattctccagggcctgggcttcaacctcacacacacaccagagtctgccatccaccagggcttccagcacctggttcactcactgactgttcccagcaaagacctgaccttgaagatgggaagtgccctcttcgtcaagaaggagctgcagctgcaggcaaatttcttgggcaatgtcaagaggctgtatgaagcagaagtcttttctacagatttctccaacccctccattgcccaggcgaggatcaacagccatgtgaaaaagaagacccaagggaaggttgtagacataatccaaggccttgaccttctgacggccatggttctggtgaatcacattttctttaaagccaagtgggagaagccctttcaccttgaatatacaagaaagaacttcccattcctggtgggcgagcaggtcactgtgcaagtccccatgatgcaccagaaagagcagttcgcttttggggtggatacagagctgaactgctttgtgctgcagatggattacaagggagatgccgtggccttctttgtcctccctagcaagggcaagatgaggcaactggaacaggccttgtcagccagaacactgataaagtggagccactcactccagaaaaggtggatagaggtgttcatccccagattttccatttctgcctcctacaatctggaaaccatcctcccgaagatgggcatccaaaatgcctttgacaaaaatgctgatttttctggaattgcaaagagagactccctgcaggtttctaaagcaacccacaaggctgtgctggatgtcagtgaagagggcactgaggccacagcagctaccaccaccaagttcatagtccgatcgaaggatggtccctcttacttcactgtctccttcaataggaccttcctgatgatgattacaaataaagccacagacggtattctctttctagggaaagtggaaaatcccactaaatcctaggtgggaaatggcctgttaactgatggcacattgctaatgcacaagaaataacaaaccacatccctctttctgttctgagggtgcatttgaccccagtggagctggattcgctggcagggatgccacttccaaggctcaatcaccaaaccatcaacagggaccccagtcacaagccaacacccattaaccccagtcagtgcccttttccacaaattctcccaggtaactagcttcatgggatgttgctgggttaccatatttccattccttggggctcccaggaatggaaatacgccaacccaggttaggcacctctattgcagaattacaataacacattcaataaaactaaaatatgaattcaaaaaaaaaaaaaaaaaaaaaaaaaaaaaaaaaaaaaaaaaaaaaaaaaaaaaaaaaaaaaaaaaaa

SEQ ID NO: 224 - protein, 417 aa, Homo sapiens
MASYLYGVLFAVGLCAPIYCVSPANAPSAYPRPSSTKSTPASQVYSLNTDFAFRLYRRLVLETPSQNIFFSPVSVSTSLAMLSLGAHSVTKTQILQGLGFNLTHTPESAIHQGFQHLVHSLTVPSKDLTLKMGSALFVKKELQLQANFLGNVKRLYEAEVFSTDFSNPSIAQARINSHVKKKTQGKVVDIIQGLDLLTAMVLVNHIFFKAKWEKPFHLEYTRKNFPFLVGEQVTVQVPMMHQKEQFAFGVDTELNCFVLQMDYKGDAVAFFVLPSKGKMRQLEQALSARTLIKWSHSLQKRWIEVFIPRFSISASYNLETILPKMGIQNAFDKNADFSGIAKRDSLQVSKATHKAVLDVSEEGTEATAATTTKFIVRSKDGPSYFTVSFNRTFLMMITNKATDGILFLGKVENPTKS

SEQ ID NO: 225 - DNA, 957 bp, Homo sapiens
gggagagaggataaatagcagcgtggcttccctggctcctctctgcatccttcccgaccttcccagcaatatgcatcttgcacgtctggtcggctcctgctccctccttctgctactgggggccctgtctggatgggcggccagcgatgaccccattgagaaggtcattgaagggatcaaccgagggctgagcaatgcagagagagaggtgggcaaggccctggatggcatcaacagtggaatcacgcatgccggaagggaagtggagaaggttttcaacggacttagcaacatggggagccacaccggcaaggagttggacaaaggcgtccaggggctcaaccacggcatggacaaggttgcccatgagatcaaccatggtattggacaagcaggaaaggaagcagagaagcttggccatggggtcaacaacgctgctggacaggccgggaaggaagcagacaaagcggtccaagggttccacactggggtccaccaggctgggaaggaagcagagaaacttggccaaggggtcaaccatgctgctgaccaggctggaaaggaagtggagaagcttggccaaggtgcccaccatgctgctggccaggccgggaaggagctgcagaatgctcataatggggtcaaccaagccagcaaggaggccaaccagctgctgaatggcaaccatcaaagcggatcttccagccatcaaggaggggccacaaccacgccgttagcctctggggcctcagtcaacacgcctttcatcaaccttcccgccctgtggaggagcgtcgccaacatcatgccctaaactggcatccggccttgctgggagaataatgtcgccgttgtcacatcagctgacatgacctggaggggttgggggtgggggacaggtttctgaaatccctgaagggggttgtactgggatttgtgaataaacttgatacacca

SEQ ID NO: 226 - protein, 247 aa, Homo sapiens
MHLARLVGSCSLLLLLGALSGWAASDDPIEKVIEGINRGLSNAEREVGKALDGINSGITHAGREVEKVFNGLSNMGSHTGKELDKGVQGLNHGMDKVAHEINHGIGQAGKEAEKLGHGVNNAAGQAGKEADKAVQGFHTGVHQAGKEAEKLGQGVNHAADQAGKEVEKLGQGAHHAAGQAGKELQNAHNGVNQASKEANQLLNGNHQSGSSSHQGGATTTPLASGASVNTPFINLPALWRSVANIMP

SEQ ID NO: 227 - DNA, 904 bp, Homo sapiens
gaagtagaggtgttgtgctgagcggcgctcggcgaactgtgtggaccgtctgctgggactccggccctgcgtccgctcagccccgtggccccgcgcacctactgccatggagacgcggcctcgtctcggggccacctgtttgctgggcttcagtttcctgctcctcgtcatctcttctgatggacataatgggcttggaaagggttttggagatcatattcattggaggacactggaagatgggaagaaagaagcagctgccagtggactgcccctgatggtgattattcataaatcctggtgtggagcttgcaaagctctaaagcccaaatttgcagaatctacggaaatttcagaactctcccataattttgttatggtaaatcttgaggatgaagaggaacccaaagatgaagatttcagccctgacgggggttatattccacgaatcctttttctggatcccagtggcaaggtgcatcctgaaatcatcaatgagaatggaaaccccagctacaagtatttttatgtcagtgccgagcaagttgttcaggggatgaaggaagctcaggaaaggctgacgggtgatgccttcagaaagaaacatcttgaagatgaattgtaacatgaatgtgccccttctttcatcagagttagtgttctggaaggaaagcagcagggaagggaatattgaggaatcatctagaacaattaagccgaccaggaaacctcattcctacctacactggaaggagcgctctcactgtggaagagttctgctaacagaagctggtctgcatgtttgtggatccagcggagagtggcagactttcttctccttttccctctcacctaaatgtcaacttgtcattgaatgtaaagaatgaaaccttctgacacaaaa

SEQ ID NO: 228 - protein, 172 aa, Homo sapiens
METRPRLGATCLLGFSFLLLVISSDGHNGLGKGFGDHIHWRTLEDGKKEAAASGLPLMVIIHKSWCGACKALKPKFAESTEISELSHNFVMVNLEDEEEPKDEDFSPDGGYIPRILFLDPSGKVHPEIINENGNPSYKYFYVSAEQVVQGMKEAQERLTGDAFRKKHLEDEL

SEQ ID NO: 229 - DNA, 1942 bp, Homo sapiens
cccacgcgtccgcccacgcgtccgggtgccactcgcgcgccggccgcgctccgggcttctcttttccctccgacgcgccacggctgcccagacattccggctgccgggtctggagagctccccgaacccctccgcggagaggagcgaggcggcgccagggtggcccccggggcgcgcttggtctcggagaagcggggacgaggccggaggatgagcgactgagggcgacgcgggcactgacgcgagttggggccgcgactaccggcagctgacagcgcgatgagcgactccccagagacgccctagcccggtgtgcgcgccaggcggagcgcgcaggtggggctgggctgttagtggtccgccccacgcgggtcgccggccggcccaggatgggcgctggcaacccgggcccgcgcccgccgctgctacccctgcgcccgctgcgagcccggcgtccggcccgcgccctgcgctcatggacggcggctcccggctggcggcggcgcgcccccgggctgtgaatgcgactcgcccctcggccgcgctccccgcccgcccgcccgccgggacgtggtaggggatgcccagctccactgcgatggcagttggcgcgctctccagttccctcctggtcacctgctgcctgatggtggctctgtgcagtccgagcatcccgctggagaagctggcccaggcaccagagcagccgggccaggagaagcgtgagcacgccactcgggacggcccggggcgggtgaacgagctcgggcgcccggcgagggacgagggcggcagcggccgggactggaagagcaagagcggccgtgggctcgccggccgtgagccgtggagcaagctgaagcaggcctgggtctcccagggcgggggcgccaaggccggggatctgcaggtccggccccgcggggacaccccgcaggcggaagccctggccgcagccgcccaggacgcgattggcccggaactcgcgcccacgcccgagccacccgaggagtacgtgtacccggactaccgtggcaagggctgcgtggacgagagcggcttcgtgtacgcgatcggggagaagttcgcgccgggcccctcggcctgcccgtgcctgtgcaccgaggaggggccgctgtgcgcgcagcccgagtgcccgaggctgcacccgcgctgcatccacgtcgacacgagccagtgctgcccgcagtgcaaggagaggaagaactactgcgagttccggggcaagacctatcagactttggaggagttcgtggtgtctccatgcgagaggtgtcgctgtgaagccaacggtgaggtgctatgcacagtgtcagcgtgtccccagacggagtgtgtggaccctgtgtacgagcctgatcagtgctgtcccatctgcaaaaatggtccaaactgctttgcagaaaccgcggtgatccctgctggcagagaagtgaagactgacgagtgcaccatatgccactgtacttatgaggaaggcacatggagaatcgagcggcaggccatgtgcacgagacatgaatgcaggcaaatgtagacgcttcccagaacacaaactctgactttttctagaacattttactgatgtgaacattctagatgactctgggaactatcagtcaaagaagacttttgatgaggaataatggaaaattgttggtacttttccttttcttgataacagttactacaacagaaggaaatggatatatttcaaaacatcaacaagaactttgggcataaaatccttctctaaataaatgtgctattttcacagtaagtacacaaaagtacactattatatatcaaatgtatttctataatccctccattagagagcttatataagtgttttctatagatgcagattaaaaatgctgtgttgtcaaccgtcaaaaaaaaaaaaaaaaaaaaaaaaaaa

SEQ ID NO: 230 - protein, 325 aa, Homo sapiens
MPSSTAMAVGALSSSLLVTCCLMVALCSPSIPLEKLAQAPEQPGQEKREHATRDGPGRVNELGRPARDEGGSGRDWKSKSGRGLAGREPWSKLKQAWVSQGGGAKAGDLQVRPRGDTPQAEALAAAAQDAIGPELAPTPEPPEEYVYPDYRGKGCVDESGFVYAIGEKFAPGPSACPCLCTEEGPLCAQPECPRLHPRCIHVDTSQCCPQCKERKNYCEFRGKTYQTLEEFVVSPCERCRCEANGEVLCTVSACPQTECVDPVYEPDQCCPICKNGPNCFAETAVIPAGREVKTDECTICHCTYEEGTWRIERQAMCTRHECRQM

SEQ ID NO: 231 - DNA, 1728 bp, Homo sapiens
ggccggacgcctccgcgttacgggatgaattaacggcgggttccgcacggaggttgtgacccctacggagccccagcttgcccacgcaccccactcggcgtcgcgcggcgtgccctgcttgtcacaggtgggaggctggaactatcaggctgaaaaacagagtgggtactctcttctgggaagctggcaacaaatggatgatgtgatatatgcattccaggggaagggaaattgtggtgcttctgaacccatggtcaattaacgaggcagtttctagctactgcacgtacttcataaagcaggactctaaaagctttggaatcatggtgtcatggaaagggatttactttatactgactctgttttggggaagcttttttggaagcattttcatgctgagtccctttttacctttgatgtttgtaaacccatcttggtatcgctggatcaacaaccgccttgtggcaacatggctcaccctacctgtggcattattggagaccatgtttggtgtaaaagtgattataactggggatgcatttgttcctggagaaagaagtgtcattatcatgaaccatcggacaagaatggactggatgttcctgtggaattgcctgatgcgatatagctacctcagattggagaaaatttgcctcaaagcgagtctcaaaggtgttcctggatttggttgggccatgcaggctgctgcctatatcttcattcataggaaatggaaggatgacaagagccatttcgaagacatgattgattacttttgtgatattcacgaaccacttcaactcctcatattcccagaagggactgatctcacagaaaacagcaagtctcgaagtaatgcatttgctgaaaaaaatggacttcagaaatatgaatatgttttacatccaagaactacaggctttacttttgtggtagaccgtctaagagaaggtaagaaccttgatgctgtccatgatatcactgtggcgtatcctcacaacattcctcaatcagagaagcacctcctccaaggagactttcccagggaaatccactttcacgtccaccggtatccaatagacaccctccccacatccaaggaggaccttcaactctggtgccacaaacggtgggaagagaaagaagagaggctgcgttccttctatcaaggggagaagaatttttattttaccggacagagtgtcattccaccttgcaagtctgaactcagggtccttgtggtcaaattgctctctatactgtattggaccctgttcagccctgcaatgtgcctactcatatatttgtacagtcttgttaagtggtattttataatcaccattgtaatctttgtgctgcaagagagaatatttggtggactggagatcatagaacttgcatgttaccgacttttacacaaacagccacatttaaattcaaagaaaaatgagtaagattataaggtttgccatgtgaaaacctagagcatattttggaaatgttctaaacctttctaagctcagatgcatttttgcatgactatgtcgaatatttcttactgccatcattatttgttaaagatattttgcacttaattttgtgggaaaaatattgctacaattttttttaatctctgaatgtaatttcgatactgtgtacatagcagggagtgatcggggtgaaataacttgggccagaatattattaaacaatcatcaggcttttaaa

SEQ ID NO: 232 - protein, 414 aa, Homo sapiens [sequence omitted]

SEQ ID NO: 233 - DNA, 1630 bp, Homo sapiens
cggctcgagtgcagctgtggggagatttcagtgcattgcctcccctgggtgctcttcatcttggatttgaaagttgagagcagcatgttttgcccactgaaactcatcctgctgccagtgttactggattattccttgggcctgaatgacttgaatgtttccccgcctgagctaacagtccatgtgggtgattcagctctgatgggatgtgttttccagagcacagaagacaaatgtatattcaagatagactggactctgtcaccaggagagcacgccaaggacgaatatgtgctatactattactccaatctcagtgtgcctattgggcgcttccagaaccgcgtacacttgatgggggacatcttatgcaatgatggctctctcctgctccaagatgtgcaagaggctgaccagggaacctatatctgtgaaatccgcctcaaaggggagagccaggtgttcaagaaggcggtggtactgcatgtgcttccagaggagcccaaagagctcatggtccatgtgggtggattgattcagatgggatgtgttttccagagcacagaagtgaaacacgtgaccaaggtagaatggatattttcaggacggcgcgcaaaggaggagattgtatttcgttactaccacaaactcaggatgtctgtggagtactcccagagctggggccacttccagaatcgtgtgaacctggtgggggacattttccgcaatgacggttccatcatgcttcaaggagtgagggagtcagatggaggaaactacacctgcagtatccacctagggaacctggtgttcaagaaaaccattgtgctgcatgtcagcccggaagagcctcgaacactggtgaccccggcagccctgaggcctctggtcttgggtggtaatcagttggtgatcattgtgggaattgtctgtgccacaatcctgctgctccctgttctgatattgatcgtgaagaagacctgtggaaataagagttcagtgaattctacagtcttggtgaagaacacgaagaagactaatccagagataaaagaaaaaccctgccattttgaaagatgtgaaggggagaaacacatttactccccaataattgtacgggaggtgatcgaggaagaagaaccaagtgaaaaatcagaggccacctacatgaccatgcacccagtttggccttctctgaggtcagatcggaacaactcacttgaaaaaaagtcaggtgggggaatgccaaaaacacagcaagccttttgagaagaatggagagtcccttcatctcagcagcggtggagactctctcctgtgtgtgtcctgggccactctaccagtgatttcagactcccgctctcccagctgtcctcctgtctcattgtttggtcaatacactgaagatggagaatttggagcctggcagagagactggacagctctggaggaacaggcctgctgaggggaggggagcatggacttggcctctggagtgggacactggccctgggaaccaggctgagctgagtggcctcaaaccccccgttggatcagaccctcctgtgggcagggttcttagtggatgagttactgggaagaatcagagataaaaaccaacccaaatcaa

SEQ ID NO: 234 - protein, 394 aa, Homo sapiens
MFCPLKLILLPVLLDYSLGLNDLNVSPPELTVHVGDSALMGCVFQSTEDKCIFKIDWTLSPGEHAKDEYVLYYYSNLSVPIGRFQNRVHLMGDILCNDGSLLLQDVQEADQGTYICEIRLKGESQVFKKAVVLHVLPEEPKELMVHVGGLIQMGCVFQSTEVKHVTKVEWIFSGRRAKEEIVFRYYHKLRMSVEYSQSWGHFQNRVNLVGDIFRNDGSIMLQGVRESDGGNYTCSIHLGNLVFKKTIVLHVSPEEPRTLVTPAALRPLVLGGNQLVIIVGIVCATILLLPVLILIVKKTCGNKSSVNSTVLVKNTKKTNPEIKEKPCHFERCEGEKHIYSPIIVREVIEEEEPSEKSEATYMTMHPVWPSLRSDRNNSLEKKSGGGMPKTQQAF

SEQ ID NO: 235 - DNA, 537 bp, Homo sapiens
taaaacagctacaatattccagggccagtcacttgccatttctcataacagcgtcagagagaaagaactgactgaaacgtttgagatgaagaaagttctcctcctgatcacagccatcttggcagtggctgttggtttcccagtctctcaagaccaggaacgagaaaaaagaagtatcagtgacagcgatgaattagcttcagggttttttgtgttcccttacccatatccatttcgcccacttccaccaattccatttccaagatttccatggtttagacgtaattttcctattccaatacctgaatctgcccctacaactccccttcctagcgaaaagtaaacaagaaggataagtcacgataaacctggtcacctgaaattgaaattgagccacttccttgaagaatcaaaattcctgttaataaaagaaaaacaaatgtaattgaaatagcacacagcattctctagtcaatatctttagtgatcttctttaataaacatgaaagcaaagattttggtttcttaatttccaca

SEQ ID NO: 236 - protein, 85 aa, Homo sapiens
MKKVLLLITAILAVAVGFPVSQDQEREKRSISDSDELASGFFVFPYPYPFRPLPPIPFPRFPWFRRNFPIPIPESAPTTPLPSEK

SEQ ID NO: 237 - DNA, 1315 bp, Homo sapiens
tcgccatggcctctgccggaatgcagatcctgggagtcgtcctgacactgctgggctgggtgaatggcctggtctcctgtgccctgcccatgtggaaggtgaccgctttcatcggcaacagcatcgtggtggcccaggtggtgtgggagggcctgtggatgtcctgcgtggtgcagagcaccggccagatgcagtgcaaggtgtacgactcactgctggcgctgccacaggacctgcaggctgcacgtgccctctgtgtcatcgccctccttgtggccctgttcggcttgctggtctaccttgctggggccaagtgtaccacctgtgtggaggagaaggattccaaggcccgcctggtgctcacctctgggattgtctttgtcatctcaggggtcctgacgctaatccccgtgtgctggacggcgcatgccatcatccgggacttctataaccccctggtggctgaggcccaaaagcgggagctgggggcctccctctacttgggctgggcggcctcaggccttttgttgctgggtggggggttgctgtgctgcacttgcccctcgggggggtcccagggccccagccattacatggcccgctactcaacatctgcccctgccatctctcgggggccctctgagtaccctaccaagaattacgtctgacgtggaggggaatgggggctccgctggcgctagagccatccagaagtggcagtgcccaacagctttgggatgggttcgtaccttttgtttctgcctcctgctatttttcttttgactgaggatatttaaaattcatttgaaaactgagccaaggtgttgactcagactctcacttaggctctgctgtttctcacccttggatgatggagccaaagaggggatgctttgagattctggatcttgacatgcccatcttagaagccagtcaagctatggaactaatgcggaggctgcttgctgtgctggctttgcaacaagacagactgtccccaagagttcctgctgctgctgggggctgggcttccctagatgtcactggacagctgccccccatcctactcaggtctctggagctcctctcttcacccctggaaaaacaaatcatctgttaacaaaggactgcccacctccggaacttctgacctctgtttcctccgtcctgataagacgtccaccccccagggccaggtcccagctatgtagacccccgcccccacctccaacactgcacccttctgccctgcccccctcgtctcaccccctttacactcacatttttatcaaataaagcatgttttgttagtgca

SEQ ID NO: 238 - protein, 220 aa, Homo sapiens
MASAGMQILGVVLTLLGWVNGLVSCALPMWKVTAFIGNSIVVAQVVWEGLWMSCVVQSTGQMQCKVYDSLLALPQDLQAARALCVIALLVALFGLLVYLAGAKCTTCVEEKDSKARLVLTSGIVFVISGVLTLIPVCWTAHAIIRDFYNPLVAEAQKRELGASLYLGWAASGLLLLGGGLLCCTCPSGGSQGPSHYMARYSTSAPAISRGPSEYPTKNYV

SEQ ID NO: 239 - DNA, 535 bp, Homo sapiens
agtgacaatctcagagcagcttctacaccacagccatttccagcatgaagatcactgggggtctccttctgctctgtacagtggtctatttctgtagcagctcagaagctgctagtctgtctccaaaaaaagtggactgcagcatttacaagaagtatccagtggtggccatcccctgccccatcacatacctaccagtttgtggttctgactacatcacctatgggaatgaatgtcacttgtgtaccgagagcttgaaaagtaatggaagagttcagtttcttcacgatggaagttgctaaattctccatggacatagagagaaaggaatgatattctcatcatcatcttcatcatcccaggctctgactgagtttctttcagttttactgatgttctgggtgggggacagagccagattcagagtaatcttgactgaatggagaaagtttctgtgctacccctacaaacccatgcctcactgacagaccagcattttttttttaacacgtcaataaaaaaataatctcccaga

SEQ ID NO: 240 - protein, 85 aa, Homo sapiens
MKITGGLLLLCTVVYFCSSSEAASLSPKKVDCSIYKKYPVVAIPCPITYLPVCGSDYITYGNECHLCTESLKSNGRVQFLHDGSC

SEQ ID NO: 241 - DNA, 742 bp, Homo sapiens
cccgcgcccggttctccctcgcagcacctcgaagtgcgcccctcgccctcctgctcgcgccccgccgccatggctgcctcccccgcgcggcctgctgtcctggccctgaccgggctggcgctgctcctgctcctgtgctggggcccaggtggcataagtggaaataaactcaagctgatgcttcaaaaacgagaagcacctgttccaactaagactaaagtggccgttgatgagaataaagccaaagaattccttggcagcctgaagcgccagaagcggcagctgtgggaccggactcggcccgaggtgcagcagtggtaccagcagtttctctacatgggctttgatgaagcgaaatttgaagatgacatcacctattggcttaacagagatcgaaatggacatgaatactatggcgattactaccaacgtcactatgatgaagactctgcaattggtccccggagcccctacggctttaggcatggagccagcgtcaactacgatgactactaaccatgacttgccacacgctgtacaagaagcaaatagcgattctcttcatgtatctcctaatgccttacactacttggtttctgatttgctctatttcagcagatcttttctacctactttgtgtgatcaaaaaagaagagttaaaacaacacatgtaaatgccttttgatatttcatgggaatgcctctcatttaaaaatagaaataaagcattttgttaaaaaga

SEQ ID NO: 242 - protein, 148 aa, Homo sapiens
MAASPARPAVLALTGLALLLLLCWGPGGISGNKLKLMLQKREAPVPTKTKVAVDENKAKEFLGSLKRQKRQLWDRTRPEVQQWYQQFLYMGFDEAKFEDDITYWLNRDRNGHEYYGDYYQRHYDEDSAIGPRSPYGFRHGASVNYDDY

SEQ ID NO: 243 - DNA, 2119 bp, Homo sapiens
ctccattaaaccaccaccagctccccaagccaccccttcagccatgaagttcctgctcctggtcttggcagccctcggattcctgacccaggtgatcccagccagtgcaggtgggtcaaaatgtgtgagtaacaccccaggatactgcaggacatgttgccactggggggagacagcattgttcatgtgcaacgcttccagaaaatgctgcatcagctactccttcctgccgaagcctgacctaccacagctcatcggtaaccactggcaatcaaggagaagaaacacacaaaggaaagacaagaagcaacaaacgaccgtaacatcataataaccactgctatcgcctccaccaactcagagaaatatcatttccacagttccaattcctcctacattgctgagtactagccaaggctcctctttatggggcagatatctatagccaaccccaaaacttctgtcttctatcattctgtcattcatctagtaactaatttggagtttgtatctatcttacgagaacaatcatcatgcagattcgtccacaggggatctgtcagtttgggtcctccaaatgaaaaatgtcaagacagaattggacatgcaaaagattgactgggagaacacacctctgatggacaaaggtgagacagagcagccacaggcagggagagccttcagactgcaacgctggcctgatacgtgtcaaaggagagagggatagaggaggattgaatagaaggagactaagactgcagctctaagaaagtctcagccaaacagatggggaggcccaaagcaaggcttgcccctcagaggagctcacgcagggcaggaatagccaggttctcatatcccaggggttcagacttggctgagaacagcccctggagaacatggggtgactgctaccataggtctggaagtatgaggctgtccaccaactatccccttgaagcaagttctcttgaaaggaaatctaaacagtgcacccccatggctgccacggagtataaggagggagagaaaggagctgaaagtctaggtttggccagctaggtagactgacttgtgaggtatttatttattcatttgagtaacaaagcagacagaatacatagccaccattggtagtacaccccaaaagcaaggatggcatgatgctggtgactcaaacgtgcctactcatggtgtcaaattggcataatcctcttgggaagctgtgtggaaataagcacagagaagcagaactctaattgcttaatccactaaacattacttctgggaattggctcatcataaattatccaagagaaagcacaaagttatgggcacaaaggttttccatataatattatttaaaatgctgagaaaatgaaaaaatctaaatggtgaaatatatactaatgccatctataaatacaaacaaatagaatgtttatagaataatggaacataataacattattcaaaattgcatttatgctatagttgtcaaaattgtctccttatatgatacaaaactcatgaaaattatgacttttttgtttggttggaaagcagaattatgcataaatttcctcttacagttcgatgcccattagttttatataacatttatttgacacgtactgacttctatctgagaagaacaaaccaaaacactcaggcctaaataattaaaaacggtcctaaaaactagcaaaccagataagaaaagatgttaatgcccattccctaacttatgtcttagaccaaaattaattctagatggttttaaaatgacagtgtaaaagtaaagtattaaaagattgtgtggtcaaatattcaatttaagagcaaggaaattcttataaatataacaatagaggcagaactcatgtaagaataaattgattaggtggtattaaatattaagttcttatgtatgtcaaaagatatcattttgaaattcatccatcttattgggtattgcaggagttcattcctttttgtttataaatactcttccgtcatatgaatagtattcatttgtatactggtttgttgatggacatttgggttgttcccagtttatggctattacaaataaagcttctatgaacatttatgtaca

SEQ ID NO: 244 - protein, 95 aa, Homo sapiens
MKFLLLVLAALGFLTQVIPASAGGSKCVSNTPGYCRTCCHWGETALFMCNASRKCCISYSFLPKPDLPQLIGNHWQSRRRNTQRKDKKQQTTVTS

SEQ ID NO: 245 - DNA, 1257 bp, Homo sapiens
ggagagaggcgcgcgggtgaaaggcgcattgatgcagcctgcggcggcctcggagcgcggcggagccagacgctgaccacgttcctctcctcggtctcctccgcctccagctccgcgctgcccggcagccgggagccatgcgaccccagggccccgccgcctccccgcagcggctccgcggcctcctgctgctcctgctgctgcagctgcccgcgccgtcgagcgcctctgagatccccaaggggaagcaaaaggcgcagctccggcagagggaggtggtggacctgtataatggaatgtgcttacaagggccagcaggagtgcctggtcgagacgggagccctggggccaatgttattccgggtacacctgggatcccaggtcgggatggattcaaaggagaaaagggggaatgtctgagggaaagctttgaggagtcctggacacccaactacaagcagtgttcatggagttcattgaattatggcatagatcttgggaaaattgcggagtgtacatttacaaagatgcgttcaaatagtgctctaagagttttgttcagtggctcacttcggctaaaatgcagaaatgcatgctgtcagcgttggtatttcacattcaatggagctgaatgttcaggacctcttcccattgaagctataatttatttggaccaaggaagccctgaaatgaattcaacaattaatattcatcgcacttcttctgtggaaggactttgtgaaggaattggtgctggattagtggatgttgctatctgggttggcacttgttcagattacccaaaaggagatgcttctactggatggaattcagtttctcgcatcattattgaagaactaccaaaataaatgctttaattttcatttgctacctctttttttattatgccttggaatggttcacttaaatgacattttaaataagtttatgtatacatctgaatgaaaagcaaagctaaatatgtttacagaccaaagtgtgatttcacactgtttttaaatctagcattattcattttgcttcaatcaaaagtggtttcaatattttttttagttggttagaatactttcttcatagtcacattctctcaacctataatttggaatattgttgtggtcttttgttttttctcttagtatagcatttttaaaaaaatataaaagctaccaatctttgtacaatttgtaaatgttaagaattttttttatatctgttaaataaaaattatttccaaca

SEQ ID NO: 246 - protein, 243 aa, Homo sapiens [sequence omitted]

SEQ ID NO: 247 - DNA, 2134 bp, Homo sapiens
ggccgttggttggtgcgcggctgaagggtgtggcgcgagcagcgtcgttggttggccggcggcgggccgggacgggcatggccctgctgctgtgcctggtgtgcctgacggcggcgctggcccacggctgtctgcactgccacagcaacttctccaagaagttctccttctaccgccaccatgtgaacttcaagtcctggtgggtgggcgacatccccgtgtcaggggcgctgctcaccgactggagcgacgacacgatgaaggagctgcacctggccatccccgccaagatcacccgggagaagctggaccaagtggcgacagcagtgtaccagatgatggatcagctgtaccaggggaagatgtacttccccgggtatttccccaacgagctgcgaaacatcttccgggagcaggtgcacctcatccagaacgccatcatcgaaaggcacctggcaccaggcagctggggaggagggcagctctccagggagggacccagcctagcacctgaaggatcaatgccatcaccccgcggggacctcccctaagtagcccccagaggcgctgggagtgttgccaccgccctcccctgaagtttgctccatctcacgctgggggtcaacctggggaccccttccctccgggccatggacacacatacatgaaaaccaggccgcatcgactgtcagcaccgctgtggcatcttccagtacgagaccatctcctgcaacaactgcacagactcgcacgtcgcctgctttggctataactgcgagtagggctcaggcatcacacccacccgtgccagggccctactgtccctggggtcccaggctctccttggagggggctccccgccttccacctggctgtcatcgggtagggcggggccgtgggttcaggggcgcaccacttccaagcctgtgtcccacaggtcctcggcgcagtggaagtcagctgtccagggcctcctgaactacataaataactggcacaagtaagtcccctcctcaaaccaacacaggcagtgtgtgtatgtgagcacctcgtgggtgagtatgtgtggggcacaggctggctccctcagctcccacgtcctagaggggctcccgaggaggtggaacctcaacccagctctgcgcaggaggcggctgcagtccttttctccctcaaaggtctccgaccctcagctggaggcgggcatctttcctaaagggtccccatagggtctggttccaccccatcccaggtctgtggtcagagcctgggagggttccctacgatggttaggggtgccccatggaggggctgactgccccacattgcctttcagacaggacacgagcatgaggtaaggccgccctgacctggacttcagggggagggggtaaagggagagaggaggggggctagggggtcctctagatcagtgggggcactgcaggtggggctctccctatacctgggacacctgctggatgtcacctctgcaaccacacccatgtggtggtttcatgaacagaccacgctcctctgccttctcctggcctgggacacacagagccaccccggccttgtgagtgacccagagaagggaggcctcgggagaaggggtgctcgtaagccaacaccagcgtgccgcggcctgcacacccttcggacatcccaggcacgagggtgtcgtggatgtggccacacataggaccacacgtcccagctgggaggagaggcctggggcccccagggagggaggcagggggtgggggacatggagagctgaggcagcctcgtctccccgcagcctggtatcgccagccttaaggtgtctggagcccccacacttggccaacctgaccttggaagatgctgctgagtgtctcaagcagcactgacagcagctgggcctgccccagggcaacgtgggggcggagactcagctggacagcccctgcctgtcactctggagctgggctgctgctgcctcaggaccccctctccgaccccggacagagctgagctggccagggccaggagggcgggagggagggaatgggggtgggctgtgcgcagcatcagcgcctgggcaggtccgcagagctgcgggatgtgattaaagtccctgatgtttctc

SEQ ID NO: 248 - protein, 157 aa, Homo sapiens
MALLLCLVCLTAALAHGCLHCHSNFSKKFSFYRHHVNFKSWWVGDIPVSGALLTDWSDDTMKELHLAIPAKITREKLDQVATAVYQMMDQLYQGKMYFPGYFPNELRNIFREQVHLIQNAIIERHLAPGSWGGGQLSREGPSLAPEGSMPSPRGDLP

SEQ ID NO: 249 - DNA, 2387 bp, Homo sapiens
cgacgatgctacgcgcgcccggctgcctcctccggacctccgtagcgcctgccgcggccctggctgcggcgctgctctcgtcgcttgcgcgctgctctcttctagagccgagggacccggtggcctcgtcgctcagcccctatttcggcaccaagactcgctacgaggatgtcaaccccgtgctattgtcgggccccgaggctccgtggcgggaccctgagctgctggaggggacctgcaccccggtgcagctggtcgccctcattcgccacggcacccgctaccccacggtcaaacagatccgcaagctgaggcagctgcacgggttgctgcaggcccgcgggtccagggatggcggggctagtagtaccggcagccgcgacctgggtgcagcgctggccgactggcctttgtggtacgcggactggatggacgggcagctagtagagaagggacggcaggatatgcgacagctggcgctgcgtctggcctcgctcttcccggcccttttcagccgtgagaactacggccgcctgcggctcatcaccagttccaagcaccgctgcatggatagcagcgccgccttcctgcaggggctgtggcagcactaccaccctggcttgccgccgccggacgtcgcagatatggagtttggacctccaacagttaatgataaactaatgagattttttgatcactgtgagaagtttttaactgaagtagaaaaaaatgctacagctctttatcacgtggaagccttcaaaactggaccagaaatgcagaacattttaaaaaaagttgcagctactttgcaagtgccagtaaatgatttaaatgcagatttaattcaagtagcctttttcacctgttcatttgacctggcaattaaaggtgttaaatctccttggtgtgatgtttttgacatagatgatgcaaaggtattagaatatttaaatgatctgaaacaatattggaaaagaggatatgggtatactattaacagtcgatccagctgcaccttgtttcaggatatctttcagcacttggacaaagcagttgaacagaaacaaaggtctcagccaatttcttctccagtcatcctccagtttggtcatgcagagactcttcttccactgctttctctcatgggctacttcaaagacaaggaacccctaacagcgtacaattacaaaaaacaaatgcatcggaagttccgaagtggtctcattgtaccttatgcctcgaacctgatatttgtgctttaccactgtgaaaatgctaagactcctaaagaacaattccgagtgcagatgttattaaatgaaaaggtgttacctttggcttactcacaagaaactgtttcattttatgaagatctgaagaaccactacaaggacatccttcagagttgtcaaaccagtgaagaatgtgaattagcaagggctaacagtacatctgatgaactatgagtaactgaagaacatttttaattctttaggaatctgcaatgagtgattacatgcttgtaataggtaggcaattccttgattacaggaagcttttatattacttgagtatttctgtcttttcacagaaaaacattgggtttctctctgggtttggacatgaaatgtaagaaaagatttttcactggagcagctctcttaaggagaaacaaatctatttagagaaacagctggccctgcaaatgtttacagaaatgaaattcttcctacttatataagaaatctcacactgagatagaattgtgatttcataataacacttgaaaagtgctggagtaacaaaatatctcagttggaccatccttaacttgattgaactgtctaggaactttacagattgttctgcagttctctcttcttttcctcaggtaggacagctctagcattttcttaatcaggaatattgtggtaagctgggagtatcactctggaagaaagtaacatctccagatgagaatttgaaacaagaaacagagtgttgtaaaaggacaccttcactgaagcaagtcggaaagtacaatgaaaataaatatttttggtatttatttatgaaatatttgaacattttttcaataattcctttttacttctaggaagtctcaaaagaccatcttaaattattatatgtttggacaattagcaacaagtcagatagttagaatcgaagtttttcaaatccattgcttagctaactttttcattctgtcacttggcttcgatttttatattttcctattatatgaaatgtatcttttggttgtttgatttttctttctttctttgtaaatagttctgagttctgtcaaatgccgtgaaagtatttgctataataaagaaaattcttgtgactttaaaaaaaaa

SEQ ID NO: 250 - protein, 487 aa, Homo sapiens
MLRAPGCLLRTSVAPAAALAAALLSSLARCSLLEPRDPVASSLSPYFGTKTRYEDVNPVLLSGPEAPWRDPELLEGTCTPVQLVALIRHGTRYPTVKQIRKLRQLHGLLQARGSRDGGASSTGSRDLGAALADWPLWYADWMDGQLVEKGRQDMRQLALRLASLFPALFSRENYGRLRLITSSKHRCMDSSAAFLQGLWQHYHPGLPPPDVADMEFGPPTVNDKLMRFFDHCEKFLTEVEKNATALYHVEAFKTGPEMQNILKKVAATLQVPVNDLNADLIQVAFFTCSFDLAIKGVKSPWCDVFDIDDAKVLEYLNDLKQYWKRGYGYTINSRSSCTLFQDIFQHLDKAVEQKQRSQPISSPVILQFGHAETLLPLLSLMGYFKDKEPLTAYNYKKQMHRKFRSGLIVPYASNLIFVLYHCENAKTPKEQFRVQMLLNEKVLPLAYSQETVSFYEDLKNHYKDILQSCQTSEECELARANSTSDEL

SEQ ID NO: 251 - DNA, 1777 bp, Homo sapiens
ggagagccgcggctgggaccggagtggggagcgcggcgtggaggtgccacccggcgcgggtggcggagagatcagaagcctcttccccaagccgagccaacctcagcggggacccgggctcagggacgcggcggcggcggcggcgactgcagtggctggacgatggcagcgtccgccggagccggggcggtgattgcagccccagacagccggcgctggctgtggtcggtgctggcggcggcgcttgggctcttgacagctggagtatcagccttggaagtatatacgccaaaagaaatcttcgtggcaaatggtacacaagggaagctgacctgcaagttcaagtctactagtacgactggcgggttgacctcagtctcctggagcttccagccagagggggccgacactactgtgtcgtttttccactactcccaagggcaagtgtaccttgggaattatccaccatttaaagacagaatcagctgggctggagaccttgacaagaaagatgcatcaatcaacatagaaaatatgcagtttatacacaatggcacctatatctgtgatgtcaaaaaccctcctgacatcgttgtccagcctggacacattaggctctatgtcgtagaaaaagagaatttgcctgtgtttccagtttgggtagtggtgggcatagttactgctgtggtcctaggtctcactctgctcatcagcatgattctggctgtcctctatagaaggaaaaactctaaacgggattacactggctgcagtacatcagagagtttgtcaccagttaagcaggctcctcggaagtccccctccgacactgagggtcttgtaaagagtctgccttctggatctcaccagggcccagtcatatatgcacagttagaccactccggcggacatcacagtgacaagattaacaagtcagagtctgtggtgtatgcggatatccgaaagaattaagagaatacctagaacatatcctcagcaagaaacaaaaccaaactggactctcgtgcagaaaatgtagcccattaccacatgtagccttggagacccaggcaaggacaagtacacgtgtactcacagagggagagaaagatgtgtacaaaggatatgtataaatattctatttagtcatcctgatatgaggagccagtgttgcatgatgaaaagatggtatgattctacatatgtacccattgtcttgctgtttttgtactttcttttcaggtcatttacaattgggagatttcagaaacattcctttcaccatcatttagaaatggtttgccttaatggagacaatagcagatcctgtagtatttccagtagacatggccttttaatctaagggcttaagactgattagtcttagcatttactgtagttggaggatggagatgctatgatggaagcatacccagggtggcctttagcacagtatcagtaccatttatttgtctgccgcttttaaaaaatacccattggctatgccacttgaaaacaatttgagaagtttttttgaagtttttctcactaaaatatggggcaattgttagccttacatgttgtgtagacttactttaagtttgcacccttgaaatgtgtcatatcaatttctggattcataatagcaagattagcaaaggataaatgccgaaggtcacttcattctggacacagttggatcaatactgattaagtagaaaatccaagctttgcttgagaacttttgtaacgtggagagtaaaaagtatcggtttta

SEQ ID NO: 252 - protein, 269 aa, Homo sapiens
MAASAGAGAVIAAPDSRRWLWSVLAAALGLLTAGVSALEVYTPKEIFVANGTQGKLTCKFKSTSTTGGLTSVSWSFQPEGADTTVSFFHYSQGQVYLGNYPPFKDRISWAGDLDKKDASINIENMQFIHNGTYICDVKNPPDIVVQPGHIRLYVVEKENLPVFPVWVVVGIVTAVVLGLTLLISMILAVLYRRKNSKRDYTGCSTSESLSPVKQAPRKSPSDTEGLVKSLPSGSHQGPVIYAQLDHSGGHHSDKINKSESVVYADIRKN

SEQ ID NO: 253 - DNA, 1150 bp, Homo sapiens
gtgacactatagaagagctatgacgtcgcatgcacgcgtacgtaagctcggaattcggctcgaggctggtgggaagaagccgagatggcggcagccagcgctggggcaacccggctgctcctgctcttgctgatggcggtagcagcgcccagtcgagcccggggcagcggctgccgggccgggactggtgcgcgaggggctggggcggaaggtcgagagggcgaggcctgtggcacggtggggctgctgctggagcactcatttgagatcgatgacagtgccaacttccggaagcggggctcactgctctggaaccagcaggatggtaccttgtccctgtcacagcggcagctcagcgaggaggagcggggccgactccgggatgtggcagccctgaatggcctgtaccgggtccggatcccaaggcgacccggggccctggatggcctggaagctggtggctatgtctcctcctttgtccctgcgtgctccctggtggagtcgcacctgtcggaccagctgaccctgcacgtggatgtggccggcaacgtggtgggcgtgtcggtggtgacgcaccccgggggctgccggggccatgaggtggaggacgtggacctggagctgttcaacacctcggtgcagctgcagccgcccaccacagccccaggccctgagacggcggccttcattgagcgcctggagatggaacaggcccagaaggccaagaacccccaggagcagaagtccttcttcgccaaatactggatgtacatcattcccgtcgtcctgttcctcatgatgtcaggagcgccagacaccgggggccagggtgggggtgggggtgggggtggtggtgggggtagtggcctttgctgtgtgccaccctccctgtaagtctatttaaaaacatcgacgatacattgaaatgtgtgaacgttttgaaaagctacagcttccagcagccaaaagcaactgttgttttggcaagacggtcctgatgtacaagcttgattgaaattcactgctcacttgatacgttattcagaaacccaaggaatggctgtccccatcctcatgtggctgtgtggagctcagctgtgttgtgtggcagtttattaaactgtcccccagatcgacacgcaaaaaaaaa

SEQ ID NO: 254 - protein, 269 aa, Homo sapiens [sequence omitted]

SEQ ID NO: 255 - DNA, 1098 bp, Homo sapiens
gcgacgcgcggcggggcggcgagaggaaacgcggcgccgggccgggcccggccctggagatggtccccggcgccgcgggctggtgttgtctcgtgctctggctccccgcgtgcgtcgcggcccacggcttccgtatccatgattatttgtactttcaagtgctgagtcctggggacattcgatacatcttcacagccacacctgccaaggactttggtggtatctttcacacaaggtatgagcagattcaccttgtccccgctgaacctccagaggcctgcggggaactcagcaacggtttcttcatccaggaccagattgctctggtggagagggggggctgctccttcctctccaagactcgggtggtccaggagcacggcgggcgggcggtgatcatctctgacaacgcagttgacaatgacagcttctacgtggagatgatccaggacagtacccagcgcacagctgacatccccgccctcttcctgctcggccgagacggctacatgatccgccgctctctggaacagcatgggctgccatgggccatcatttccatcccagtcaatgtcaccagcatccccacctttgagctgctgcaaccgccctggaccttctggtagaagagtttgtcccacattccagccataagtgactctgagctgggaaggggaaacccaggaattttgctacttggaatttggagatagcatctggggacaagtggagccaggtagaggaaaagggtttgggcgttgctaggctgaaagggaagccacaccactggccttcccttccccagggcccccaagggtgtctcatgctacaagaagaggcaagagacaggccccagggcttctggctagaacccgaaacaaaaggagctgaaggcaggtggcctgagagccatctgtgacctgtcacactcacctggctccagcctcccctacccagggtctctgcacagtgaccttcacagcagttgttggagtggtttaaagagctggtgtttggggactcaataaaccctcactgactttttagcaataaagcttctcatcagggttgcaaaaaaaaaaaaaaaaaaaaaaaaaa

SEQ ID NO: 256 - protein, 188 aa, Homo sapiens
MVPGAAGWCCLVLWLPACVAAHGFRIHDYLYFQVLSPGDIRYIFTATPAKDFGGIFHTRYEQIHLVPAEPPEACGELSNGFFIQDQIALVERGGCSFLSKTRVVQEHGGRAVIISDNAVDNDSFYVEMIQDSTQRTADIPALFLLGRDGYMIRRSLEQHGLPWAIISIPVNVTSIPTFELLQPPWTFW

SEQ ID NO: 257 - DNA, 764 bp, Homo sapiens
ctcgcttcttccttctggatgggggcccagggggcccaggagagtataaaggcgatgtggagggtgcccggcacaaccagacgcccagtcacaggcgagagccctgggatgcaccggccagaggccatgctgctgctgctcacgcttgccctcctggggggccccacctgggcagggaagatgtatggccctggaggaggcaagtatttcagcaccactgaagactacgaccatgaaatcacagggctgcgggtgtctgtaggtcttctcctggtgaaaagtgtccaggtgaaacttggagactcctgggacgtgaaactgggagccttaggtgggaatacccaggaagtcaccctgcagccaggcgaatacatcacaaaagtctttgtcgccttccaagctttcctccggggtatggtcatgtacaccagcaaggaccgctatttctattttgggaagcttgatggccagatctcctctgcctaccccagccaagaggggcaggtgctggtgggcatctatggccagtatcaactccttggcatcaagagcattggctttgaatggaattatccactagaggagccgaccactgagccaccagttaatctcacatactcagcaaactcacccgtgggtcgctagggtggggtatggggccatccgagctgaggccatctgtgtggtggtggctgatggtactggagtaactgagtcgggacgctgaatctgaatccaccaataaataaagcttctgcagaaaa

SEQ ID NO: 258 - protein, 178 aa, Homo sapiens
MHRPEAMLLLLTLALLGGPTWAGKMYGPGGGKYFSTTEDYDHEITGLRVSVGLLLVKSVQVKLGDSWDVKLGALGGNTQEVTLQPGEYITKVFVAFQAFLRGMVMYTSKDRYFYFGKLDGQISSAYPSQEGQVLVGIYGQYQLLGIKSIGFEWNYPLEEPTTEPPVNLTYSANSPVGR

SEQ ID NO: 259 - DNA, 798 bp, Homo sapiens
  unsure 794: unknown base
cagacatggctcagtcactggctctgagcctccttatcctggttctggcctttggcatccccaggacccaaggcagtgatggaggggctcaggactgttgcctcaagtacagccaaaggaagattcccgccaaggttgtccgcagctaccggaagcaggaaccaagcttaggctgctccatcccagctatcctgttcttgccccgcaagcgctctcaggcagagctatgtgcagacccaaaggagctctgggtgcagcagctgatgcagcatctggacaagacaccatccccacagaaaccagcccagggctgcaggaaggacaggggggcctccaagactggcaagaaaggaaagggctccaaaggctgcaagaggactgagcggtcacagacccctaaagggccatagcccagtgagcagcctggagccctggagaccccaccagcctcaccagcgcttgaagcctgaacccaagatgcaagaaggaggctatgctcaggggccctggagcagccaccccatgctggccttgccacactctttctcctgctttaaccaccccatctgcattcccagctctaccctgcatggctgagctgcccacagcaggccaggtccagagagaccgaggagggagagtctcccagggagcatgagaggaggcagcaggactgtccccttgaaggagaatcatcaggaccctggacctgatacggctccccagtacaccccacctcttccttgtaaatatgatttatacctaactgaataaaaagctgttctgtcttcccnccca

SEQ ID NO: 260 - protein, 134 aa, Homo sapiens
MAQSLALSLLILVLAFGIPRTQGSDGGAQDCCLKYSQRKIPAKVVRSYRKQEPSLGCSIPAILFLPRKRSQAELCADPKELWVQQLMQHLDKTPSPQKPAQGCRKDRGASKTGKKGKGSKGCKRTERSQTPKGP

SEQ ID NO: 261 - DNA, 3554 bp, Homo sapiens
gggactacaagccgcgccgcgctgccgctggcccctcagcaaccctcgacatggcgctgaggcggccaccgcgactccggctctgcgctcggctgcctgacttcttcctgctgctgcttttcaggggctgcctgataggggctgtaaatctcaaatccagcaatcgaaccccagtggtacaggaatttgaaagtgtggaactgtcttgcatcattacggattcgcagacaagtgaccccaggatcgagtggaagaaaattcaagatgaacaaaccacatatgtgttttttgacaacaaaattcagggagacttggcgggtcgtgcagaaatactggggaagacatccctgaagatctggaatgtgacacggagagactcagccctttatcgctgtgaggtcgttgctcgaaatgaccgcaaggaaattgatgagattgtgatcgagttaactgtgcaagtgaagccagtgacccctgtctgtagagtgccgaaggctgtaccagtaggcaagatggcaacactgcactgccaggagagtgagggccacccccggcctcactacagctggtatcgcaatgatgtaccactgcccacggattccagagccaatcccagatttcgcaattcttctttccacttaaactctgaaacaggcactttggtgttcactgctgttcacaaggacgactctgggcagtactactgcattgcttccaatgacgcaggctcagccaggtgtgaggagcaggagatggaagtctatgacctgaacattggcggaattattgggggggttctggttgtccttgctgtactggccctgatcacgttgggcatctgctgtgcatacagacgtggctacttcatcaacaataaacaggatggagaaagttacaagaacccagggaaaccagatggagttaactacatccgcactgacgaggagggcgacttcagacacaagtcatcgtttgtgatctgagacccgcggtgtggctgagagcgcacagagcgcacgtgcacatacctctgctagaaactcctgtcaaggcagcgagagctgatgcactcggacagagctagacactcattcagaagcttttcgttttggccaaagttgaccactactcttcttactctaacaagccacatgaatagaagaattttcctcaagatggacccggtaaatataaccacaaggaagcgaaactgggtgcgttcactgagttgggttcctaatctgtttctggcctgattcccgcatgagtattagggtgatcttaaagagtttgctcacgtaaacgcccgtgctgggccctgtgaagccagcatgttcaccactggtcgttcagcagccacgacagcaccatgtgagatggcgaggtggctggacagcaccagcagcgcatcccggcgggaacccagaaaaggcttcttacacagcagccttacttcatcggcccacagacaccaccgcagtttcttcttaaaggctctgctgatcggtgttgcagtgtccattgtggagaagctttttggatcagcattttgtaaaaacaaccaaaatcaggaaggtaaattggttgctggaagagggatcttgcctgaggaaccctgcttgtccaacagggtgtcaggatttaaggaaaaccttcgtcttaggctaagtctgaaatggtactgaaatatgcttttctatgggtcttgtttattttataaaattttacatctaaatttttgctaaggatgtattttgattattgaaaagaaaatttctatttaaactgtaaatatattgtcatacaatgttaaataacctatttttttaaaaaagttcaacttaaggtagaagttccaagctactagtgttaaattggaaaatatcaataattaagagtattttacccaaggaatcctctcatggaagtttactgtgatgttccttttctcacacaagttttagcctttttcacaagggaactcatactgtctacacatcagaccatagttgcttaggaaacctttaaaaattccagttaagcaatgttgaaatcagtttgcatctcttcaaaagaaacctctcaggttagctttgaactgcctcttcctgagatgactaggacagtctgtacccagaggccacccagaagccctcagatgtacatacacagatgccagtcagctcctggggttgcgccaggcgcccccgctctagctcactgttgcctcgctgtctgccaggaggccctgccatccttgggccctggcagtggctgtgtcccagtgagctttactcacgtggcccttgcttcatccagcacagctctcaggtgggcactgcagggacactggtgtcttccatgtagcgtcccagctttgggctcctgtaacagacctctttttggttatggatggctcacaaaatagggcccccaatgctattttttttttttaagtttgtttaattatttgttaagattgtctaaggccaaaggcaattgcgaaatcaagtctgtcaagtacaataacatttttaaaagaaaatggatcccactgttcctctttgccacagagaaagcacccagacgccacaggctctgtcgcatttcaaaacaaaccatgatggagtggcggccagtccagccttttaaagaacgtcaggtggagcagccaggtgaaaggcctggcggggaggaaagtgaaacgcctgaatcaaaagcagttttctaattttgactttaaatttttcatccgccggagacactgctcccatttgtggggggacattagcaacatcactcagaagcctgtgttcttcaagagcaggtgttctcagcctcacatgccctgccgtgctggactcaggactgaagtgctgtaaagcaaggagctgctgagaaggagcactccactgtgtgcctggagaatggctctcactactcaccttgtctttcagcttccagtgtcttgggttttttatactttgacagcttttttttaattgcatacatgagactgtgttgactttttttagttatgtgaaacactttgccgcaggccgcctggcagaggcaggaaatgctccagcagtggctcagtgctccctggtgtctgctgcatggcatcctggatgcttagcatgcaagttccctccatcattgccaccttggtagagagggatggctccccaccctcagcgttggggattcacgctccagcctccttcttggttgtcatagtgatagggtagccttattgccccctcttcttataccctaaaaccttctacactagtgccatgggaaccaggtctgaaaaagtagagagaagtgaaagtagagtctgggaagtagctgcctataactgagactagacggaaaaggaatactcgtgtattttaagatatgaatgtgactcaagactcgaggccgatacgaggctgtgattctgcctttggatggatgttgctgtacacagatgctacagacttgtactaacacaccgtaatttggcatttgtttaacctcatttataaaagcttcaaaaaaaccca

SEQ ID NO: 262 - protein, 310 aa, Homo sapiens
MALRRPPRLRLCARLPDFFLLLLFRGCLIGAVNLKSSNRTPVVQEFESVELSCIITDSQTSDPRIEWKKIQDEQTTYVFFDNKIQGDLAGRAEILGKTSLKIWNVTRRDSALYRCEVVARNDRKEIDEIVIELTVQVKPVTPVCRVPKAVPVGKMATLHCQESEGHPRPHYSWYRNDVPLPTDSRANPRFRNSSFHLNSETGTLVFTAVHKDDSGQYYCIASNDAGSARCEEQEMEVYDLNIGGIIGGVLVVLAVLALITLGICCAYRRGYFINNKQDGESYKNPGKPDGVNYIRTDEEGDFRHKSSFVI

SEQ ID NO: 263 - DNA, 2570 bp, Homo sapiens
ccaggaccagggcgcaccggctcagcctctcacttgtcagaggccggggaagagaagcaaagcgcaacggtgtggtccaagccggggcttctgcttcgcctctaggacatacacgggaccccctaacttcagtcccccaaacgcgcaccctcgaagtcttgaactccagccccgcacatccacgcgcggcacaggcgcggcaggcggcaggtcccggccgaaggcgatgcgcgcagggggtcgggcagctgggctcgggcggcgggagtagggcccggcagggaggcagggaggctgcatattcagagtcgcgggctgcgccctgggcagaggccgccctcgctccacgcaacacctgctgctgccaccgcgccgcgatgagccgcgtggtctcgctgctgctgggcgccgcgctgctctgcggccacggagccttctgccgccgcgtggtcagcggccaaaaggtgtgttttgctgacttcaagcatccctgctacaaaatggcctacttccatgaactgtccagccgagtgagctttcaggaggcacgcctggcttgtgagagtgagggaggagtcctcctcagccttgagaatgaagcagaacagaagttaatagagagcatgttgcaaaacctgacaaaacccgggacagggatttctgatggtgatttctggatagggctttggaggaatggagatgggcaaacatctggtgcctgcccagatctctaccagtggtctgatggaagcaattcccagtaccgaaactggtacacagatgaaccttcctgcggaagtgaaaagtgtgttgtgatgtatcaccaaccaactgccaatcctggccttgggggtccctacctttaccagtggaatgatgacaggtgtaacatgaagcacaattatatttgcaagtatgaaccagagattaatccaacagcccctgtagaaaagccttatcttacaaatcaaccaggagacacccatcagaatgtggttgttactgaagcaggtataattcccaatctaatttatgttgttataccaacaatacccctgctcttactgatactggttgcttttggaacctgttgtttccagatgctgcataaaagtaaaggaagaacaaaaactagtccaaaccagtctacactgtggatttcaaagagtaccagaaaagaaagtggcatggaagtataataactcattgacttggttccagaattttgtaattctggatctgtataaggaatggcatcagaacaatagcttggaatggcttgaaatcacaaaggatctgcaagatgaactgtaagctcccccttgaggcaaatattaaagtaatttttatatgtctattatttcatttaaagaatatgctgtgctaataatggagtgagacatgcttattttgctaaaggatgcacccaaacttcaaacttcaagcaaatgaaatggacaatgcagataaagttgttatcaacacgtcgggagtatgtgtgttagaagcaattccttttatttctttcacctttcataagttgttatctagtcaatgtaatgtatattgtattgaaatttacagtgtgcaaaagtattttacctttgcataagtgtttgataaaaatgaactgttctaatatttatttttatggcatctcatttttcaatacatgctcttttgattaaagaaacttattactgttgtcaactgaattcacacacacacaaatatagtaccatagaaaaagtttgttttctcgaaataattcatctttcagcttctctgcttttggtcaatgtctaggaaatctcttcagaaataagaagctatttcattaagtgtgatataaacctcctcaaacattttacttagaggcaaggattgtctaatttcaattgtgcaagacatgtgccttataattatttttagcttaaaattaaacagattttgtaataatgtaactttgttaataggtgcataaacactaatgcagtcaatttgaacaaaagaagtgacatacacaatataaatcatatgtcttcacacgttgcctatataatgagaagcagctctctgagggttctgaaatcaatgtggtccctctcttgcccactaaacaaagatggttgttcggggtttgggattgacactggaggcagatagttgcaaagttagtctaaggtttccctagctgtatttagcctctgactatattagtatacaaagaggtcatgtggttgagaccaggtgaatagtcactatcagtgtggagacaagcacagcacacagacattttaggaaggaaaggaactacgaaatcgtgtgaaaatgggttggaacccatcagtgatcgcatattcattgatgagggtttgcttgagatagaaaatggtggctcctttctgtcttatctcctagtttcttcaatgcttacgccttgttcttctcaagagaaagttgtaactctctggtcttcatatgtccctgtgctccttttaaccaaataaagagttcttgtttctgggggaaaaaaaaaaaaaaaaaaaaaaaaaaaaaaaaaaaaaaaa

SEQ ID NO: 264 - protein, 273 aa, Homo sapiens
MSRVVSLLLGAALLCGHGAFCRRVVSGQKVCFADFKHPCYKMAYFHELSSRVSFQEARLACESEGGVLLSLENEAEQKLIESMLQNLTKPGTGISDGDFWIGLWRNGDGQTSGACPDLYQWSDGSNSQYRNWYTDEPSCGSEKCVVMYHQPTANPGLGGPYLYQWNDDRCNMKHNYICKYEPEINPTAPVEKPYLTNQPGDTHQNVVVTEAGIIPNLIYVVIPTIPLLLLILVAFGTCCFQMLHKSKGRTKTSPNQSTLWISKSTRKESGMEV

SEQ ID NO: 265 - DNA, 3824 bp, Homo sapiens
ggagaatggagagagcagtgagagtggagtccggggtcctggtcggggtggtctgtctgctcctggcatgccctgccacagccactgggcccgaagttgctcagcctgaagtagacaccaccctgggtcgtgtgcgaggccggcaggtgggcgtgaagggcacagaccgccttgtgaatgtctttctgggcattccatttgcccagccgccactgggccctgaccggttctcagccccacacccagcacagccctgggagggtgtgcgggatgccagcactgcgcccccaatgtgcctacaagacgtggagagcatgaacagcagcagatttgtcctcaacggaaaacagcagatcttctccgtttcagaggactgcctggtcctcaacgtctatagcccagctgaggtccccgcagggtccggtaggccggtcatggtatgggtccatggaggcgctctgataactggcgctgccacctcctacgatggatcagctctggctgcctatggggatgtggtcgtggttacagtccagtaccgccttggggtccttggcttcttcagcactggagatgagcatgcacctggcaaccagggcttcctagatgtggtagctgctttgcgctgggtgcaagaaaacatcgcccccttcgggggtgacctcaactgtgtcactgtctttggtggatctgccggtgggagcatcatctctggcctggtcctgtccccagtggctgcagggctgttccacagagccatcacacagagtggggtcatcaccaccccagggatcatcgactctcacccttggcccctagctcagaaaatcgcaaacaccttggcctgcagctccagctccccggctgagatggtgcagtgccttcagcagaaagaaggagaagagctggtccttagcaagaagctgaaaaatactatctatcctctcaccgttgatggcactgtcttccccaaaagccccaaggaactcctgaaggagaagcccttccactctgtgcccttcctcatgggtgtcaacaaccatgagttcagctggctcatccccaggggctggggtctcctggatacaatggagcagatgagccgggaggacatgctggccatctcaacacccgtcttgaccagtctggatgtgccccctgagatgatgcccaccgtcatagatgaatacctaggaagcaactcggacgcacaagccaaatgccaggcgttccaggaattcatgggtgacgtattcatcaatgttcccaccgtcagtttttcaagataccttcgagattctggaagccctgtctttttctatgagttccagcatcgacccagttcttttgcgaagatcaaacctgcctgggtgaaggctgatcatggggccgagggtgcttttgtgttcggaggtcccttcctcatggacgagagctcccgcctggcctttccagaggccacagaggaggagaagcagctaagcctcaccatgatggcccagtggacccactttgcccggacaggggaccccaatagcaaggctctgcctccttggccccaattcaaccaggcggaacaatatctggagatcaacccagtgccacgggccggacagaagttcagggaggcctggatgcagttctggtcagagacgctccccagcaagatacaacagtggcaccagaagcagaagaacaggaaggcccaggaggacctctgaggccaggcctgaaccttcttggctggggcaaaccactcttcaagtggtggcagagtcccagcacggcagcccgcctctccccctgctgagactttaatctccaccagcccttaaagtgtcggccgctctgtgactggagttatgctcttttgaaatgtcacaaggccgcctcccacctctggggcattgtacaagttcttccctctccctgaagtgcctttcctgctttcttcgtggtaggttctagcacattcctctagcttcctggaggactcactccccaggaagccttccctgccttctctgggctgtgcggccccgagtctgcgtccattagagcacagtccacccgaggctagcaccgtgtctgtgtctgtctccccctcagaggagctctctcaaaatggggattagcctaaccccactctgtcacccacaccaggatcgggtgggacctggagctagggggtgtttgctgagtgagtgagtgaaacacagaatatgggaatggcagctgctgaacttgaacccagagccttcaggtgccaaagccatactcaggcccccaccgacattgtccaccctggccagaagggtgcatgccaatggcagagacctgggatgggagaagtcctggggcgccaggggatccagcctagagcagaccttagcccctgactaaggcctcagactagggcgggaggggtctcctcctctctgctgcccagtcctggcccctgcacaagacaacagaatccatcagggccatgagtgtcacccagacctgaccctcaccaattccagcccctgaccctcaggacgctggatgccagctcccagccccagtgccgggtcctccctcccttcctggcttggggagaccagtttctggggagcttccaagagcacccaccaagacacagcaggacaggccaggggagggcatctggaccagggcatccgtcgggctattgtcacagagaaaagaagagacccacccactcgggctgcaaaaggtgaaaagcaccaagaggttttcagatggaagtgagaggtgacagtgtgctggcagccctcacagccctcgcttgctctccctgccgcctctgcctgggctcccactttggcagcacttgaggagcccttcaacccgccgctgcactgtaggagcccctttctgggctggccaaggccggagccagctccctcagcttgcggggaggtgcggagggagaggggcgggcaggaaccggggctgcgcgcagcgcttgcgggccagagtgagttccgggtgggcgtgggctcggcggggccccactcagagcagctggccggccccaggcagtgagggccttagcacctgggccagcagctgctgtgctcgatttctcgctgggccttagctgcctccccgcggggcagggctcgggacctgcagccctccatgcctgaccctccccccaccccccgtgggctcctgtgcggccggagcctccccaaggagcgccgccccctgctccacagcgcccagtcccatcgaccacccaagggctgaggagtgcgggtgcacagcgcgggactggcaggcagctccacctgctgccccagtgctggatccactgggtgaagccagctgggctcctgagtctggtggggacttggagaacctttatgtctagctaagggattgtaaatacaccgatgggcactctgtatctagctcaaggtttgtaaacacaccaatcagcaccctgtgtctagctcagtgtttgtgaatgcaccaatccacactctgtatctggctactctggtggggacttggagaacctttgtgtccacactctgtatctagctaatctagtggggatgtggagaacctttgtgtctagctcagggatcgtaaacgcaccaatcagcaccctgtcaaaacagaccacttgactctctgtaaaatggaccaatcagcaggatgtgggtggggcgagacaagagaataaaagcaggctgcctgagccagcagtgacaacccccctcgggtcccctcccacgccgtggaagctttgttctttcgctctttgcaataaatcttgctactgcccaaaa

SEQ ID NO: 266 - protein, 571 aa, Homo sapiens
MERAVRVESGVLVGVVCLLLACPATATGPEVAQPEVDTTLGRVRGRQVGVKGTDRLVNVFLGIPFAQPPLGPDRFSAPHPAQPWEGVRDASTAPPMCLQDVESMNSSRFVLNGKQQIFSVSEDCLVLNVYSPAEVPAGSGRPVMVWVHGGALITGAATSYDGSALAAYGDVVVVTVQYRLGVLGFFSTGDEHAPGNQGFLDVVAALRWVQENIAPFGGDLNCVTVFGGSAGGSIISGLVLSPVAAGLFHRAITQSGVITTPGIIDSHPWPLAQKIANTLACSSSSPAEMVQCLQQKEGEELVLSKKLKNTIYPLTVDGTVFPKSPKELLKEKPFHSVPFLMGVNNHEFSWLIPRGWGLLDTMEQMSREDMLAISTPVLTSLDVPPEMMPTVIDEYLGSNSDAQAKCQAFQEFMGDVFINVPTVSFSRYLRDSGSPVFFYEFQHRPSSFAKIKPAWVKADHGAEGAFVFGGPFLMDESSRLAFPEATEEEKQLSLTMMAQWTHFARTGDPNSKALPPWPQFNQAEQYLEINPVPRAGQKFREAWMQFWSETLPSKIQQWHQKQKNRKAQEDL

SEQ ID NO: 267 - DNA, 3721 bp, Homo sapiens
tgtcgcctggccctcgccatgcagaccccgcgagcgtcccctccccgcccggccctcctgcttctgctgctgctactggggggcgcccacggcctctttcctgaggagccgccgccgcttagcgtggcccccagggactacctgaaccactatcccgtgtttgtgggcagcgggcccggacgcctgacccccgcagaaggtgctgacgacctcaacatccagcgagtcctgcgggtcaacaggacgctgttcattggggacagggacaacctctaccgcgtagagctggagccccccacgtccacggagctgcggtaccagaggaagctgacctggagatctaaccccagcgacataaacgtgtgtcggatgaagggcaaacaggagggcgagtgtcgaaacttcgtaaaggtgctgctccttcgggacgagtccacgctctttgtgtgcggttccaacgccttcaacccggtgtgcgccaactacagcatagacaccctgcagcccgtcggagacaacatcagcggtatggcccgctgcccgtacgaccccaagcacgccaatgttgccctcttctctgacgggatgctcttcacagctactgttaccgacttcctagccattgatgctgtcatctaccgcagcctcggggacaggcccaccctgcgcaccgtgaaacatgactccaagtggttcaaagagccttactttgtccatgcggtggagtggggcagccatgtctacttcttcttccgggagattgcgatggagtttaactacctggagaaggtggtggtgtcccgcgtggcccgagtgtgcaagaacgacgtgggaggctccccccgcgtgctggagaagcagtggacgtccttcctgaaggcgcggctcaactgctctgtacccggagactcccatttctacttcaacgtgctgcaggctgtcacgggcgtggtcagcctcgggggccggcccgtggtcctggccgttttttccacgcccagcaacagcatccctggctcggctgtctgcgcctttgacctgacacaggtggcagctgtgtttgaaggccgcttccgagagcagaagtcccccgagtccatctggacgccggtgccggaggatcaggtgcctcgaccccggcccgggtgctgcgcagcccccgggatgcagtacaatgcctccagcgccttgccggatgacatcctcaactttgtcaagacccaccctctgatggacgaggcggtgccctcgctgggccatgcgccctggatcctgcggaccctgatgaggcaccagctgactcgagtggctgtggacgtgggagccggcccctggggcaaccagaccgttgtcttcctgggttctgaggcggggacggtcctcaagttcctcgtccggcccaatgccagcacctcagggacgtctgggctcagtgtcttcctggaggagtttgagacctaccggccggacaggtgtggacggcccggcggtggcgagacagggcagcggctgctgagcttggagctggacgcagcttcggggggcctgctggctgccttcccccgctgcgtggtccgagtgcctgtggctcgctgccagcagtactcggggtgtatgaagaactgtatcggcagtcaggacccctactgcgggtgggcccccgacggctcctgcatcttcctcagcccgggcaccagagccgcctttgagcaggacgtgtccggggccagcacctcaggcttaggggactgcacaggactcctgcgggccagcctctccgaggaccgcgcggggctggtgtcggtgaacctgctggtaacgtcgtcggtggcggccttcgtggtgggagccgtggtgtccggcttcagcgtgggctggttcgtgggcctccgtgagcggcgggagctggcccggcgcaaggacaaggaggccatcctggcgcacggggcgggcgaggcggtgctgagcgtcagccgcctgggcgagcgcagggcgcagggtcccgggggccggggcggaggcggtggcggtggcgccggggttcccccggaggccctgctggcgcccctgatgcagaacggctgggccaaggccacgctgctgcagggcgggccccacgacctggactcggggctgctgcccacgcccgagcagacgccgctgccgcagaagcgcctgcccactccgcacccgcacccccacgccctgggcccccgcgcctgggaccacggccaccccctgctcccggcctccgcttcatcctccctcctgctgctggcgcccgcccgggcccccgagcagccccccgcgcctggggagccgacccccgacggccgcctctatgctgcccggcccggccgcgcctcccacggcgacttcccgctcaccccccacgccagcccggaccgccggcgggtggtgtccgcgcccacgggccccttggacccagcctcagccgccgatggcctcccgcggccctggagcccgcccccgacgggcagcctgaggaggccactgggcccccacgcccctccggccgccaccctgcgccgcacccacacgttcaacagcggcgaggcccggcctggggaccgccaccgcggctgccacgcccggccgggcacagacttggcccacctcctcccctatgggggggcggacaggactgcgccccccgtgccctaggccgggggccccccgatgccttggcagtgccagccacgggaaccaggagcgagagacggtgccagaacgccggggcccggggcaactccgagtgggtgctcaagtcccccccgcgacccacccgcggagtggggggccccctccgccacaaggaagcacaaccagctcgccctccccctacccggggccgcaggacgctgagacggtttgggggtgggtgggcgggaggactttgctatggatttgaggttgaccttatgcgcgtaggttttggtttttttttgcagttttggtttcttttgcggttttctaaccaattgcacaactccgttctcggggtggcggcaggcaggggaggcttggacgccggtggggaatggggggccacagctgcagacctaagccctcccccacccctggaaaggtccctccccaacccaggcccctggcgtgtgtgggtgtgcgtgcgtgtgcgtgccgtgttcgtgtgcaaggggccggggaggtgggcgtgtgtgtgcgtgccagcgaaggctgctgtgggcgtgtgtgtcaagtgggccacgcgtgcagggtgtgtgtccacgagcgacgatcgtggtggccccagcggcctgggcgttggctgagccgacgctggggcttccagaaggcccgggggtctccgaggtgccggttaggagtttgaaccccccccactctgcagagggaagcggggacaatgccggggtttcaggcaggagacacgaggagggcctgcccggaagtcacatcggcagcagctgtctaaagggcttgggggcctggggggcggcgaaggtgggtggggcccctctgtaaatacggccccagggtggtgagagagtcccatgccacccgtccccttgtgacctcccccctatgacctccagctgaccatgcatgccacgtggctggctgggtcctctgccctctttggagtttgcctcccccagccccctccccatcaataaaactctgtttacaaccaaaaaaaaaaaaaaaaaaaaaaaaaaaa

SEQ ID NO: 268 - protein, 888 aa, Homo sapiens
MQTPRASPPRPALLLLLLLLGGAHGLFPEEPPPLSVAPRDYLNHYPVFVGSGPGRLTPAEGADDLNIQRVLRVNRTLFIGDRDNLYRVELEPPTSTELRYQRKLTWRSNPSDINVCRMKGKQEGECRNFVKVLLLRDESTLFVCGSNAFNPVCANYSIDTLQPVGDNISGMARCPYDPKHANVALFSDGMLFTATVTDFLAIDAVIYRSLGDRPTLRTVKHDSKWFKEPYFVHAVEWGSHVYFFFREIAMEFNYLEKVVVSRVARVCKNDVGGSPRVLEKQWTSFLKARLNCSVPGDSHFYFNVLQAVTGVVSLGGRPVVLAVFSTPSNSIPGSAVCAFDLTQVAAVFEGRFREQKSPESIWTPVPEDQVPRPRPGCCAAPGMQYNASSALPDDILNFVKTHPLMDEAVPSLGHAPWILRTLMRHQLTRVAVDVGAGPWGNQTVVFLGSEAGTVLKFLVRPNASTSGTSGLSVFLEEFETYRPDRCGRPGGGETGQRLLSLELDAASGGLLAAFPRCVVRVPVARCQQYSGCMKNCIGSQDPYCGWAPDGSCIFLSPGTRAAFEQDVSGASTSGLGDCTGLLRASLSEDRAGLVSVNLLVTSSVAAFVVGAVVSGFSVGWFVGLRERRELARRKDKEAILAHGAGEAVLSVSRLGERRAQGPGGRGGGGGGGAGVPPEALLAPLMQNGWAKATLLQGGPHDLDSGLLPTPEQTPLPQKRLPTPHPHPHALGPRAWDHGHPLLPASASSSLLLLAPARAPEQPPAPGEPTPDGRLYAARPGRASHGDFPLTPHASPDRRRVVSAPTGPLDPASAADGLPRPWSPPPTGSLRRPLGPHAPPAATLRRTHTFNSGEARPGDRHRGCHARPGTDLAHLLPYGGADRTAPPVP

SEQ ID NO: 269 - DNA, 457 bp, Homo sapiens
atctgagtgagctaactgacacaatgaaactgtcaggcatgtttctgctcctctctctggctcttttctgctttttaacaggtgtcttcagtcagggaggacaggttgactgtggtgagttccaggaccccaaggtctactgcactcgggaatctaacccacactgtggctctgatggccagacatatggcaataaatgtgccttctgtaaggccatagtgaaaagtggtggaaagattagcctaaagcatcctggaaaatgctgagttaaagccaatgtttcttggtgacttgccagcttttgcagccttcttttctcacttctgcttatacttttgctggtggattcctttaattcataaagacatacctactctgcctgggtcttgaggagttcaatgtatgtctatttctcttgattcacttgtcaataaagtacattctgcaaaagcaaaaa

SEQ ID NO: 270 - protein, 80 aa, Homo sapiens
MKLSGMFLLLSLALFCFLTGVFSQGGQVDCGEFQDPKVYCTRESNPHCGSDGQTYGNKCAFCKAIVKSGGKISLKHPGKC

SEQ ID NO: 271 - DNA, 1177 bp, Homo sapiens
aacttctacatgggcctcctgctgctggtgctcttcctcagcctcctgccggtggcctacaccatcatgtccctcccaccctcctttgactgcgggccgttcaggtgcagagtctcagttgcccgggagcacctcccctcccgaggcagtctgctcagagggcctcggcccagaattccagttctggtttcatgccagcctgtaaaaggccatggaactttgggtgaatcaccgatgccatttaagagggttttctgccaggatggaaatgttaggtcgttctgtgtctgcgctgttcatttcagtagccaccagccacctgtggccgttgagtgcttgaaatgaggaactgagaaaattaatttctcatgtatttttctcatttatttattaatttttaactgatagttgtacatatttgggggtacatgtgatatttggatacatgtatacaatatataatgatcaaatcagggtaactgggatatccatcacatcaaacatttattttttattctttttagacagagtctcactctgtcacccaggctggagtgcagtggtgccatctcagcttactgcaacctctgcctgccaggttcaagcgattctcatgcctccacctcccaagtagctgggactacaggcatgcaccacaatgcccaactaatttttgtatttttagtagagacggggttttgccatgttgcccaggctggccttgaactcctggcctcaaacaatccacttgcctcggcctcccaaagtgttatgattacaggcgtgagccaccgtgcctggcctaaacatttatcttttctttgtgttgggaactttgaaattatacaatgaattattgttaactgtcatctccctgctgtgctatggaacactgggacttcttccctctatctaactgtatatttgtaccagttaaccaaccgtacttcatccccactcctctctatccttcccaacctctgatcacctcattctactctctacctccatgagatccacttttttagctcccacatgtgagtaagaaaatgcaatatttgtctttctgtgcctggcttatttcacttaacataatgacttcctgttccatccatgttgctgcaaatgacaggatttcgttcttaatttcaattaaaataaccacacatggcaaaaa

SEQ ID NO: 272 - protein, 111 aa, Homo sapiens
MGLLLLVLFLSLLPVAYTIMSLPPSFDCGPFRCRVSVAREHLPSRGSLLRGPRPRIPVLVSCQPVKGHGTLGESPMPFKRVFCQDGNVRSFCVCAVHFSSHQPPVAVECLK

SEQ ID NO: 273 - DNA, 2061 bp, Homo sapiens
ttctgaagtaacggaagctaccttgtataaagacctcaacactgctgaccatgatcagcgcagcctggagcatcttcctcatcgggactaaaattgggctgttccttcaagtagcacctctatcagttatggctaaatcctgtccatctgtgtgtcgctgcgatgcgggtttcatttactgtaatgatcgctttctgacatccattccaacaggaataccagaggatgctacaactctctaccttcagaacaaccaaataaataatgctgggattccttcagatttgaaaaacttgctgaaagtagaaagaatatacctataccacaacagtttagatgaatttcctaccaacctcccaaagtatgtaaaagagttacatttgcaagaaaataacataaggactatcacttatgattcactttcaaaaattccctatctggaagaattacatttagatgacaactctgtctctgcagttagcatagaagagggagcattccgagacagcaactatctccgactgcttttcctgtcccgtaatcaccttagcacaattccctggggtttgcccaggactatagaagaactacgcttggatgataatcgcatatccactatttcatcaccatctcttcaaggtctcactagtctaaaacgcctggttctagatggaaacctgttgaacaatcatggtttaggtgacaaagttttcttcaacctagttaatttgacagagctgtccctggtgcggaattccctgactgctgcaccagtaaaccttccaggcacaaacctgaggaagctttatcttcaagataaccacatcaatcgggtgcccccaaatgctttttcttatctaaggcagctctatcgactggatatgtccaataataacctaagtaatttacctcagggtatctttgatgatttggacaatataacacaactgattcttcgcaacaatccctggtattgcgggtgcaagatgaaatgggtacgtgactggttacaatcactacctgtgaaggtcaacgtgcgtgggctcatgtgccaagccccagaaaaggttcgtgggatggctattaaggatctcaatgcagaactgtttgattgtaaggacagtgggattgtaagcaccattcagataaccactgcaatacccaacacagtgtatcctgcccaaggacagtggccagctccagtgaccaaacagccagatattaagaaccccaagctcactaaggatcaacaaaccacagggagtccctcaagaaaaacaattacaattactgtgaagtctgtcacctctgataccattcatatctcttggaaacttgctctacctatgactgctttgagactcagctggcttaaactgggccatagcccggcatttggatctataacagaaacaattgtaacaggggaacgcagtgagtacttggtcacagccctggagcctgattcaccctataaagtatgcatggttcccatggaaaccagcaacctctacctatttgatgaaactcctgtttgtattgagactgaaactgcaccccttcgaatgtacaaccctacaaccaccctcaatcgagagcaagagaaagaaccttacaaaaaccccaatttacctttggctgccatcattggtggggctgtggccctggttaccattgcccttcttgctttagtgtgttggtatgttcataggaatggatcgctcttctcaaggaactgtgcatatagcaaagggaggagaagaaaggatgactatgcagaagctggcactaagaaggacaactctatcctggaaatcagggaaacttcttttcagatgttaccaataagcaatgaacccatctcgaaggaggagtttgtaatacacaccatatttcctcctaatggaatgaatctgtacaaaaacaatcacagtgaaagcagtagtaaccgaagctacagagacagtggtattccagactcagatcactcacactcatgatgctgaaggactcacagcagacttgtgttttgggttttttaaacctaagggaggtgatggt

SEQ ID NO: 274 - protein, 649 aa, Homo sapiens
MISAAWSIFLIGTKIGLFLQVAPLSVMAKSCPSVCRCDAGFIYCNDRFLTSIPTGIPEDATTLYLQNNQINNAGIPSDLKNLLKVERIYLYHNSLDEFPTNLPKYVKELHLQENNIRTITYDSLSKIPYLEELHLDDNSVSAVSIEEGAFRDSNYLRLLFLSRNHLSTIPWGLPRTIEELRLDDNRISTISSPSLQGLTSLKRLVLDGNLLNNHGLGDKVFFNLVNLTELSLVRNSLTAAPVNLPGTNLRKLYLQDNHINRVPPNAFSYLRQLYRLDMSNNNLSNLPQGIFDDLDNITQLILRNNPWYCGCKMKWVRDWLQSLPVKVNVRGLMCQAPEKVRGMAIKDLNAELFDCKDSGIVSTIQITTAIPNTVYPAQGQWPAPVTKQPDIKNPKLTKDQQTTGSPSRKTITITVKSVTSDTIHISWKLALPMTALRLSWLKLGHSPAFGSITETIVTGERSEYLVTALEPDSPYKVCMVPMETSNLYLFDETPVCIETETAPLRMYNPTTTLNREQEKEPYKNPNLPLAAIIGGAVALVTIALLALVCWYVHRNGSLFSRNCAYSKGRRRKDDYAEAGTKKDNSILEIRETSFQMLPISNEPISKEEFVIHTIFPPNGMNLYKNNHSESSSNRSYRDSGIPDSDHSHS

SEQ ID NO: 275 - DNA, 2159 bp, Homo sapiens
agggcccgcgggtggagagagcgacgcccgaggggatggcggcagcgtcccggagcgcctctggctgggcgctactgctgctggtggcactttggcagcagcgcgcggccggctccggcgtcttccagctgcagctgcaggagttcatcaacgagcgcggcgtactggccagtgggcggccttgcgagcccggctgccggactttcttccgcgtctgccttaagcacttccaggcggtcgtctcgcccggaccctgcaccttcgggaccgtctccacgccggtattgggcaccaactccttcgctgtccgggacgacagtagcggcggggggcgcaaccctctccaactgcccttcaatttcacctggccgggtaccttctcgctcatcatcgaagcttggcacgcgccaggagacgacctgcggccagaggccttgccaccagatgcactcatcagcaagatcgccatccagggctccctagctgtgggtcagaactggttattggatgagcaaaccagcaccctcacaaggctgcgctactcttaccgggtcatctgcagtgacaactactatggagacaactgctcccgcctgtgcaagaagcgcaatgaccacttcggccactatgtgtgccagccagatggcaacttgtcctgcctgcccggttggactggggaatattgccaacagcctatctgtctttcgggctgtcatgaacagaatggctactgcagcaagccagcagagtgcctctgccgcccaggctggcagggccggctgtgtaacgaatgcatcccccacaatggctgtcgccacggcacctgcagcactccctggcaatgtacttgtgatgagggctggggaggcctgttttgtgaccaagatctcaactactgcacccaccactccccatgcaagaatggggcaacgtgctccaacagtgggcagcgaagctacacctgcacctgtcgcccaggctacactggtgtggactgtgagctggagctcagcgagtgtgacagcaacccctgtcgcaatggaggcagctgtaaggaccaggaggatggctaccactgcctgtgtcctccgggctactatggcctgcactgtgaacacagcaccttgagctgcgccgactccccctgcttcaatgggggctcctgccgggagcgcaaccagggggccaactatgcttgtgaatgtccccccaacttcaccggctccaactgcgagaagaaagtggacaggtgcaccagcaacccctgtgccaacgggggacagtgcctgaaccgaggtccaagccgcatgtgccgctgccgtcctggattcacgggcacctactgtgaactccacgtcagcgactgtgcccgtaacccttgcgcccacggtggcacttgccatgacctggagaatgggctcatgtgcacctgccctgccggcttctctggccgacgctgtgaggtgcggacatccatcgatgcctgtgcctcgagtccctgcttcaacagggccacctgctacaccgacctctccacagacacctttgtgtgcaactgcccttatggctttgtgggcagccgctgcgagttccccgtgggcttgccgcccagcttcccctgggtggccgtctcgctgggtgtggggctggcagtgctgctggtactgctgggcatggtggcagtggctgtgcggcagctgcggcttcgacggccggacgacggcagcagggaagccatgaacaacttgtcggacttccagaaggacaacctgattcctgccgcccagcttaaaaacacaaaccagaagaaggagctggaagtggactgtggcctggacaagtccaactgtggcaaacagcaaaaccacacattggactataatctggccccagggcccctggggcgggggaccatgccaggaaagtttccccacagtgacaagagcttaggagagaaggcgccactgcggttacacagtgaaaagccagagtgtcggatatcagcgatatgctcccccagggactccatgtaccagtctgtgtgtttgatatcagaggagaggaatgaatgtgtcattgccacggaggtataaggcaggagcctacctggacatccctgctcagccccgcggctggaccttccttctgcattgtttaca

SEQ ID NO: 276 - protein, 685 aa, Homo sapiens
MAAASRSASGWALLLLVALWQQRAAGSGVFQLQLQEFINERGVLASGRPCEPGCRTFFRVCLKHFQAVVSPGPCTFGTVSTPVLGTNSFAVRDDSSGGGRNPLQLPFNFTWPGTFSLIIEAWHAPGDDLRPEALPPDALISKIAIQGSLAVGQNWLLDEQTSTLTRLRYSYRVICSDNYYGDNCSRLCKKRNDHFGHYVCQPDGNLSCLPGWTGEYCQQPICLSGCHEQNGYCSKPAECLCRPGWQGRLCNECIPHNGCRHGTCSTPWQCTCDEGWGGLFCDQDLNYCTHHSPCKNGATCSNSGQRSYTCTCRPGYTGVDCELELSECDSNPCRNGGSCKDQEDGYHCLCPPGYYGLHCEHSTLSCADSPCFNGGSCRERNQGANYACECPPNFTGSNCEKKVDRCTSNPCANGGQCLNRGPSRMCRCRPGFTGTYCELHVSDCARNPCAHGGTCHDLENGLMCTCPAGFSGRRCEVRTSIDACASSPCFNRATCYTDLSTDTFVCNCPYGFVGSRCEFPVGLPPSFPWVAVSLGVGLAVLLVLLGMVAVAVRQLRLRRPDDGSREAMNNLSDFQKDNLIPAAQLKNTNQKKELEVDCGLDKSNCGKQQNHTLDYNLAPGPLGRGTMPGKFPHSDKSLGEKAPLRLHSEKPECRISAICSPRDSMYQSVCLISEERNECVIATEV

SEQ ID NO: 277 - DNA, 1307 bp, Homo sapiens
ggcagtgcagccgcctcacaggtcggcggacgggccaggcgggcggcctcctgaaccgaaccgaatcggctcctcgggccgtcgtcctcccgcccctcctcgcccgccgccggagttttctttcggtttcttccaagattcctggccttccctcgacggagccgggcccagtgcgggggcgcagggcgcgggagctccacctcctcggctttccctgcgtccagaggctggcatggcgcgggccgagtactgagcgcacggtcggggcacagcagggccggggggtgcagctggctcgcgcctcctctccggccgccgtctcctccggtccctggcgaaagccattgagacaccagctggacgtcacgcgccggagcatgtctgggagtcagagcgaggtggctccatccccgcagagtccgcggagccccgagatgggacgggacttgcggcccgggtcccgcgtgctcctgctcctgcttctgctcctgctggtgtacctgactcagccaggcaatggcaacgagggcagcgtcactggaagttgttattgtggtaaaagaatttcttccgactccccgccatcggttcagttcatgaatcgtctccggaaacacctgagagcttaccatcggtgtctatactacacgaggttccagctcctttcctggagcgtgtgtgggggcaacaaggacccatgggttcaggaattgatgagctgtcttgatctcaaagaatgtggacatgcttactcggggattgtggcccaccagaagcatttacttcctaccagccccccaatttctcaggcctcagagggggcatcttcagatatccacacccctgcccagatgctcctgtccaccttgcagtccactcagcgccccaccctcccagtaggatcactgtcctcggacaaagagctcactcgtcccaatgaaaccaccattcacactgcgggccacagtctggcagctgggcctgaggctggggagaaccagaagcagccggaaaaaaatgctggtcccacagccaggacatcagccacagtgccagtcctgtgcctcctggccatcatcttcatcctcaccgcagccctttcctatgtgctgtgcaagaggaggagggggcagtcaccgcagtcctctccagatctgccggttcattatatacctgtggcacctgactctaatacctgagccaagaatggaagcttgtgagggtaaactgtggcttattcttacaaaaagtgtaataaaggagactgacccctgacaacatggtaggcactgtaaaaaaaaaaaaaa

SEQ ID NO: 278 - protein, 254 aa, Homo sapiens
MGRDLRPGSRVLLLLLLLLLVYLTQPGNGNEGSVTGSCYCGKRISSDSPPSVQFMNRLRKHLRAYHRCLYYTRFQLLSWSVCGGNKDPWVQELMSCLDLKECGHAYSGIVAHQKHLLPTSPPISQASEGASSDIHTPAQMLLSTLQSTQRPTLPVGSLSSDKELTRPNETTIHTAGHSLAAGPEAGENQKQPEKNAGPTARTSATVPVLCLLAIIFILTAALSYVLCKRRRGQSPQSSPDLPVHYIPVAPDSNT

SEQ ID NO: 279 - DNA, 3060 bp, Homo sapiens
cgcgaggcgcggggagcctgggaccaggagcgagagccgcctacctgcagccgccgcccacggcacggcagccaccatggcgctcctgctgtgcttcgtgctcctgtgcggagtagtggatttcgccagaagtttgagtatcactactcctgaagagatgattgaaaaagccaaaggggaaactgcctatctgccatgcaaatttacgcttagtcccgaagaccagggaccgctggacatcgagtggctgatatcaccagctgataatcagaaggtggatcaagtgattattttatattctggagacaaaatttatgatgactactatccagatctgaaaggccgagtacattttacgagtaatgatctcaaatctggtgatgcatcaataaatgtaacgaatttacaactgtcagatattggcacatatcagtgcaaagtgaaaaaagctcctggtgttgcaaataagaagattcatctggtagttcttgttaagccttcaggtgcgagatgttacgttgatggatctgaagaaattggaagtgactttaagataaaatgtgaaccaaaagaaggttcacttccattacagtatgagtggcaaaaattgtctgactcacagaaaatgcccacttcatggttagcagaaatgacttcatctgttatatctgtaaaaaatgcctcttctgagtactctgggacatacagctgtacagtcagaaacagagtgggctctgatcagtgcctgttgcgtctaaacgttgtccctccttcaaataaagctggactaattgcaggagccattataggaactttgcttgctctagcgctcattggtcttatcatcttttgctgtcgtaaaaagcgcagagaagaaaaatatgaaaaggaagttcatcacgatatcagggaagatgtgccacctccaaagagccgtacgtccactgccagaagctacatcggcagtaatcattcatccctggggtccatgtctccttccaacatggaaggatattccaagactcagtataaccaagtaccaagtgaagactttgaacgcactcctcagagtccgactctcccacctgctaagttcaagtacccttacaagactgatggaattacagttgtataaatatggactactgaagaatctgaagtattgtattatttgactttattttaggcctctagtaaagacttaaatgttttttaaaaaaagcacaaggcacagagattagagcagctgtaagaacacatctactttatgcaatggcattagacatgtaagtcagatgtcatgtcaaaattagtacgagccaaattctttgttaaaaaaccctatgtatagtgacactgatagttaaaagatgttttattatattttcaataactaccactaacaaatttttaacttttcatatgcatattctgatatgtggtcttttaggaaaagtatggttaatagttgatttttcaaaggaaattttaaaattcttacgttctgtttaatgtttttgctatttagttaaatacattgaagggaaatacccgttcttttccccttttatgcacacaacagaaacacgcgttgtcatgcctcaaactattttttatttgcaactacatgatttcacacaattctcttaaacaacgacataaaatagatttccttgtatataaataacttacatacgctccataaagtaaattctcaaaggtgctagaacaaatcgtccacttctacagtgttctcgtatccaacagagttgatgcacaatatataaatactcaagtccaatattaaaaacttaggcacttgactaactttaataaaatttctcaaactatatcaatatctaaagtgcatatattttttaagaaagattattctcaataacttctataaaaataagtttgatggtttggcccatctaacttcactactattagtaagaacttttaacttttaatgtgtagtaaggtttattctacctttttctcaacatgacaccaacacaatcaaaaacgaagttagtgaggtgctaacatgtgaggattaatccagtgattccggtcacaatgcattccaggaggaggtacccatgtcactggaattgggcgatatggtttattttttcttccctgatttggataaccaaatggaacaggaggaggatagtgattctgatggccattccctcgatacattcctggcttttttctgggcaaagggtgccacattggaagaggtggaaatataagttctgaaatctgtagggaagagaacacattaagttaattcaaaggaaaaaatcatcatctatgttccagatttctcattaaagacaaagttacccacaacactgagatcacatctaagtgacactcctattgtcaggtctaaatacattaaaaacctcatgtgtaataggcgtataatgtataacaggtgaccaatgttttctgaatgcataaagaaatgaataaactcaaacacagtacttcctaaacaacttcaaccaaaaaagaccaaaacatggaacgaatggaagcttgtaaggacatgcttgttttagtccagtggtttccacagctggctaagccaggagtcacttggaggcttttaaatacaaaacattggagctggaggccattatccttagcaaactaatgcagaaacagaaaatcaactaccgcatgttctcacttataagtgggaggtaatgataagaacttatgaacacaaagaaggaaacaatagacattggagtctatttgagaggggagggtgggagaaggaaaaggagcagaaaagataactattgagtactgccttcacacctgggtgatgaaataatatgtacaacaaatccctgtgacacatgtttacctatggaacaaaccttcatgtgtatccctaaacctaaaataaaagttaaaaaaaaaaaaaraaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 280 - protein, 352 aa, Homo sapiens
MALLLCFVLLCGVVDFARSLSITTPEEMIEKAKGETAYLPCKFTLSPEDQGPLDIEWLISPADNQKVDQVIILYSGDKIYDDYYPDLKGRVHFTSNDLKSGDASINVTNLQLSDIGTYQCKVKKAPGVANKKIHLVVLVKPSGARCYVDGSEEIGSDFKIKCEPKEGSLPLQYEWQKLSDSQKMPTSWLAEMTSSVISVKNASSEYSGTYSCTVRNRVGSDQCLLRLNVVPPSNKAGLIAGAIIGTLLALALIGLIIFCCRKKRREEKYEKEVHHDIREDVPPPKSRTSTARSYIGSNHSSLGSMSPSNMEGYSKTQYNQVPSEDFERTPQSPTLPPAKFKYPYKTDGITVV

SEQ ID NO: 281 - DNA, 1240 bp, Homo sapiens
tgcatcagtgcccaggcaagcccaggagttgacatttctctgcccagccatgggcctcaccctgctcttgctgctgctcctgggactagaaggtcagggcatagttggcagcctccctgaggtgctgcaggcacccgtgggaagctccattctggtgcagtgccactacaggctccaggatgtcaaagctcagaaggtgtggtgccggttcttgccggaggggtgccagcccctggtgtcctcagctgtggatcgcagagctccagcgggcaggcgtacgtttctcacagacctgggtgggggcctgctgcaggtggaaatggttaccctgcaggaagaggatgctggcgagtatggctgcatggtggatggggccagggggccccagattttgcacagagtctctctgaacatactgcccccagaggaagaagaagagacccataagattggcagtctggctgagaacgcattctcagaccctgcaggcagtgccaaccctttggaacccagccaggatgagaagagcatccccttgatctggggtgctgtgctcctggtaggtctgctggtggcagcggtggtgctgtttgctgtgatggccaagaggaaacaagaatccctcctcagtggtccaccacgtcagtgactctggaccggctgctgaattgcctttggatgtaccacacattaggcttgactcaccaccttcatttgacaataccacctacaccagcctacctcttgattccccatcaggaaaaccttcactcccagctccatcctcattgccccctctacctcctaaggtcctggtctgctccaagcctgtgacatatgccacagtaatcttcccgggagggaacaagggtggagggacctcgtgtgggccagcccagaatccacctaacaatcagactccatccagctaagctgctcatcacactttaaactcatgaggaccatccctaggggttctgtgcatccatccagccagctcatgccctaggatccttaggatatctgagcaaccagggactttaagatctaatccaatgtcctaactttactagggaaagtgacgctcagacatgactgagatgtcttggggaagacctccctgcacccaactcccccactggttcttctaccattacacactgggctaaataaaccctaataatgatgtgcaaaaaaaaaaaaaaaaaaaaaaaaaaaaaaaaaaaaaaaaaaaaaaaaa

SEQ ID NO: 282 - protein, 199 aa, Homo sapiens
MGLTLLLLLLLGLEGQGIVGSLPEVLQAPVGSSILVQCHYRLQDVKAQKVWCRFLPEGCQPLVSSAVDRRAPAGRRTFLTDLGGGLLQVEMVTLQEEDAGEYGCMVDGARGPQILHRVSLNILPPEEEEETHKIGSLAENAFSDPAGSANPLEPSQDEKSIPLIWGAVLLVGLLVAAVVLFAVMAKRKQESLLSGPPRQ

SEQ ID NO: 283 - DNA, 513 bp, Homo sapiens
gtagcatagtgtgcagttcactggaccaaaagctttggctgcacctcttctggaaagctggccatggggctcttcatgatcattgcaattctgctgttccagaaacccacagtaaccgaacaacttaagaagtgctggaataactatgtacaaggacattgcaggaaaatctgcagagtaaatgaagtgcctgaggcactatgtgaaaatgggagatactgttgcctcaatatcaaggaactggaagcatgtaaaaaaattacaaagccacctcgtccaaagccagcaacacttgcactgactcttcaagactatgttacaataatagaaaatttcccaagcctgaagacacagtctacataaatcaaatacaatttcgttttcacttgcttctcaacctagtctaataaactaaggtgatgagatatacatcttcttccttctggtttcttgatccttaaaatgaccttcgagcatattctaataaagtgcattgccagttaaaaaaaaaaa

SEQ ID NO: 284 - protein, 99 aa, Homo sapiens
MGLFMIIAILLFQKPTVTEQLKKCWNNYVQGHCRKICRVNEVPEALCENGRYCCLNIKELEACKKITKPPRPKPATLALTLQDYVTIIENFPSLKTQST

SEQ ID NO: 285 - DNA, 1571 bp, Homo sapiens
gatggcgcagccacagcttctgtgagattcgatttctccccagttcccctgtgggtctgaggggaccagaagggtgagctacgttggctttctggaaggggaggctatatgcgtcaattccccaaaacaagttttgacatttcccctgaaatgtcattctctatctattcactgcaagtgcctgctgttccaggccttacctgctgggcactaacggcggagccaggatggggacagaataaaggagccacgacctgtgccaccaactcgcactcagactctgaactcagacctgaaatcttctcttcacgggaggcttggcagtttttcttactcctgtggtctccagatttcaggcctaagatgaaagcctctagtcttgccttcagccttctctctgctgcgttttatctcctatggactccttccactggactgaagacactcaatttgggaagctgtgtgatcgccacaaaccttcaggaaatacgaaatggattttctgagatacggggcagtgtgcaagccaaagatggaaacattgacatcagaatcttaaggaggactgagtctttgcaagacacaaagcctgcgaatcgatgctgcctcctgcgccatttgctaagactctatctggacagggtatttaaaaactaccagacccctgaccattatactctccggaagatcagcagcctcgccaattcctttcttaccatcaagaaggacctccggctctctcatgcccacatgacatgccattgtggggaggaagcaatgaagaaatacagccagattctgagtcactttgaaaagctggaacctcaggcagcagttgtgaaggctttgggggaactagacattcttctgcaatggatggaggagacagaataggaggaaagtgatgctgctgctaagaatattcgaggtcaagagctccagtcttcaatacctgcagaggaggcatgaccccaaaccaccatctctttactgtactagtcttgtgctggtcacagtgtatcttatttatgcattacttgcttccttgcatgattgtctttatgcatccccaatcttaattgagaccatacttgtataagatttttgtaatatctttctgctattggatatatttattagttaatatatttatttattttttgctatttaatgtatttatttttttacttggacatgaaactttaaaaaaattcacagattatatttataacctgactagagcaggtgatgtatttttatacagtaaaaaaaaaaaaccttgtaaattctagaagagtggctaggggggttattcatttgtattcaactaaggacatatttactcatgctgatgctctgtgagatatttgaaattgaaccaatgactacttaggatgggttgtggaataagttttgatgtggaattgcacatctaccttacaattactgaccatccccagtagactccccagtcccataattgtgtatcttccagccaggaatcctacacggccagcatgtatttctacaaataaagttttctttgcataccaaaaaaaaaaaaaaaaaaa

SEQ ID NO: 286 - protein, 176 aa, Homo sapiens [sequence omitted]

SEQ ID NO: 287 - DNA, 2031 bp, Homo sapiens
  unsure 2020: unknown base
aatgccccatgcgcaccccacagctcgcgctcctgcaagtgttctttctggtgttccccgatggcgtccggcctcagccctcttcctccccatcaggggcagtgcccacgtctttggagctgcagcgagggacggatggcggaaccctccagtccccttcagaggcgactgcaactcgcccggccgtgcctggactccctacagtggtccctactctcgtgactccctcggcccctgggaataggactgtggacctcttcccagtcttaccgatctgtgtctgtgacttgactcctggagcctgcgatataaattgctgctgcgacagggactgctatcttctccatccgaggacagttttctccttctgccttccaggcagcgtaaggtcttcaagctgggtttgtgtagacaactctgttatcttcaggagtaattccccgtttccttcaagagttttcatggattctaatggaatcaggcagttttgtgtccatgtgaacaactcaaacttaaactatttccagaagcttcaaaaggtcaatgcaaccaacttccaggccctggctgcagagtttggaggcgaatcattcacttcaacattccaaactcaatcaccaccatctttttacagggctggggaccccattcttacttacttccccaagtggtctgtaataagcttgctgagacaacctgcaggagttggagctgggggactctgtgctgaaagcaatcctgcaggtttcctagagagtaaaagtacaacttgcactcgttttttcaagaacctggctagtagctgtaccttggattcagccctcaatgctgcctcttactataacttcacagtcttaaaggttccaagaagcatgactgatccacagaatatggagttccaggttcctgtaatacttacctcacaggctaatgctcctctgttggctggaaacacttgtcagaatgtagtttctcaggtcacctatgagatagagaccaatgggacttttggaatccagaaagtttctgtcagtttgggacaaaccaacctgactgttgagccaggcgcttccttacagcaacacttcatccttcgcttcagggcttttcaacagagcacagctgcttctctcaccagtcctagaagtgggaatcctggctatatagttgggaagccactcttggctctgactgatgatataagttactcaatgaccctcttacagagccagggtaatggaagttgctctgttaaaagacatgaagtgcagtttggagtgaatgcaatatctggatgcaagctcaggttgaagaaggcagactgcagccacttgcagcaggagatttatcagactcttcatggaaggcccagaccagagtatgttgccatctttggtaatgctgacccagcccagaaaggagggtggaccaggatcctcaacaggcactgcagcatttcagctataaactgtacttcctgctgtctcataccagtttccctggagatccaggtattgtgggcatatgtaggtctcctgtccaacccgcaagctcatgtatcaggagttcgattcctataccagtgccagtctatacaggattctcagcaagttacagaagtatctttgacaactcttgtgaactttgtggacattacccagaagccacagcctccaaggggccaacccaaaatggactggaaatggccattcgacttctttcccttcaaagtggcattcagcagaggagtattctctcaaaaatgctcagtctctcccatccttatcctgtgcctcttactacttggagttctcaacctagagactatgtgaagaaaagaaaataatcagatttcagttttccctatgagaaactctgaggcagccacttatcttggctaaatagaacctcacctgctcatgaccagagagcatttaggataatagatgacctaactgaaggaatccttgtatatgaaaggagttattttagaaaagcaataaaaatattttattcatcntaaaaaaaaaa

SEQ ID NO: 288 - protein, 607 aa, Homo sapiens
MRTPQLALLQVFFLVFPDGVRPQPSSSPSGAVPTSLELQRGTDGGTLQSPSEATATRPAVPGLPTVVPTLVTPSAPGNRTVDLFPVLPICVCDLTPGACDINCCCDRDCYLLHPRTVFSFCLPGSVRSSSWVCVDNSVIFRSNSPFPSRVFMDSNGIRQFCVHVNNSNLNYFQKLQKVNATNFQALAAEFGGESFTSTFQTQSPPSFYRAGDPILTYFPKWSVISLLRQPAGVGAGGLCAESNPAGFLESKSTTCTRFFKNLASSCTLDSALNAASYYNFTVLKVPRSMTDPQNMEFQVPVILTSQANAPLLAGNTCQNVVSQVTYEIETNGTFGIQKVSVSLGQTNLTVEPGASLQQHFILRFRAFQQSTAASLTSPRSGNPGYIVGKPLLALTDDISYSMTLLQSQGNGSCSVKRHEVQFGVNAISGCKLRLKKADCSHLQQEIYQTLHGRPRPEYVAIFGNADPAQKGGWTRILNRHCSISAINCTSCCLIPVSLEIQVLWAYVGLLSNPQAHVSGVRFLYQCQSIQDSQQVTEVSLTTLVNFVDITQKPQPPRGQPKMDWKWPFDFFPFKVAFSRGVFSQKCSVSPILILCLLLLGVLNLETM

SEQ ID NO: 289 - DNA, 2870 bp, Homo sapiens
cgcggagccctgcgctgggaggtgcacggtgtgcacgctggactggacccccatgcaaccccgcgccctgcgccttaaccaggactgctccgcgcgcccctgagcctcgggctccggcccggacctgcagcctcccaggtggctgggaagaactctccaacaataaatacatttgataagaaagatggctttaaaagtgctactagaacaagagaaaacgtttttcactcttttagtattactaggctatttgtcatgtaaagtgacttgtgaatcaggagactgtagacagcaagaattcagggatcggtctggaaactgtgttccctgcaaccagtgtgggccaggcatggagttgtctaaggaatgtggcttcggctatggggaggatgcacagtgtgtgacgtgccggctgcacaggttcaaggaggactggggcttccagaaatgcaagccctgtctggactgcgcagtggtgaaccgctttcagaaggcaaattgttcagccaccagtgatgccatctgcggggactgcttgccaggattttataggaagacgaaacttgtcggctttcaagacatggagtgtgtgccttgtggagaccctcctcctccttacgaaccgcactgtgccagcaaggtcaacctcgtgaagatcgcgtccacggcctccagcccacgggacacggcgctggctgccgttatctgcagcgctctggccaccgtcctgctggccctgctcatcctctgtgtcatctattgtaagagacagtttatggagaagaaacccagctggtctctgcggtcgcaggacattcagtacaacggctctgagctgtcgtgttttgacagacctcagctccacgaatatgcccacagagcctgctgccagtgccgccgtgactcagtgcagacctgcgggccggtgcgcttgctcccatccatgtgctgtgaggaggcctgcagccccaacccggcgactcttggttgtggggtgcattctgcagccagtcttcaggcaagaaacgcaggcccagccggggagatggtgccgactttcttcggatccctcacgcagtccatctgtggcgagttttcagatgcctggcctctgatgcagaatcccatgggtggtgacaacatctctttttgtgactcttatcctgaactcactggagaagacattcattctctcaatccagaacttgaaagctcaacgtctttggattcaaatagcagtcaagatttggttggtggggctgttccagtccagtctcattctgaaaactttacagcagctactgatttatctagatataacaacacactggtagaatcagcatcaactcaggatgcactaactatgagaagccagctagatcaggagagtggcgctgtcatccacccagccactcagacgtccctccaggaagcttaaagaacctgcttctttctgcagtagaagcgtgtgctggaacccaaagagtactcctttgttaggcttatggactgagcagtctggaccttgcatggcttctggggcaaaaataaatctgaaccaaactgacggcatttgaagcctttcagccagttgcttctgagccagaccagctgtaagctgaaacctcaatgaataacaagaaaagactccaggccgactcatgatactctgcatctttcctacatgagaagcttctctgccacaaaagtgacttcaaagactgatgggttgagctggcagcctatgagattgtggacatataacaagaaacagaaatgccctcatgcttattttcatggtgattgtggttttacaagactgaagacccagagtatactttttctttccagaaataatttcataccgcctatgaaatatcagataaattaccttagcttttatgtagaatgggttcaaaagtgagtgtttctatttgagaaggacactttttcatcatctaaactgattcgcataggtggttagaatggccctcatattgcctgcctaaatcttgggtttattagatgaagtttactgaatcagaggaatcagacagaggaggatagctctttccagaatccacacttctgacctcagcctcggtctcatgaacacccgctgatctcaggagaacacctgggctagggaatgtggtcgagaaagggcagcccattgcccagaattaacacatattgtagagacttgtatgcaaaggttggcatatttatatgaaaattagttgctatagaaacatttgttgcatctgtccctctgcctgagcttagaaggttatagaaaaagggtatttataaacataaatgaccttttacttgcattgtatcttatactaaaggctttagaaattacaacatatcaggttcccctactactgaagtagccttccgtgagaacacaccacatgttaggactagaagaaaatgcacaatttgtaggggtttggatgaagcagctgtaactgccctagtgtagtttgaccaggacattgtcgtgctccttccaattgtgtaagattagttagcacatcatctcctactttagccatccggtgttggatttaagaggacggtgcttctttctattaaagtgctccatcccctaccatctacacattagcattgtctctagagctaagacagaaattaaccccgttcagtcacaaagcagggaatggttcatttactcttaatctttatgccctggagaagacctacttgaacagggcatattttttagacttctgaacatcagtatgttcgagggtactatgatattttggtttggaattgccctgcccaagtcactgtcttttaacttttaaactgaatattaaaatgtatctgtctttcct

SEQ ID NO: 290 - protein, 417 aa, Homo sapiens
MALKVLLEQEKTFFTLLVLLGYLSCKVTCESGDCRQQEFRDRSGNCVPCNQCGPGMELSKECGFGYGEDAQCVTCRLHRFKEDWGFQKCKPCLDCAVVNRFQKANCSATSDAICGDCLPGFYRKTKLVGFQDMECVPCGDPPPPYEPHCASKVNLVKIASTASSPRDTALAAVICSALATVLLALLILCVIYCKRQFMEKKPSWSLRSQDIQYNGSELSCFDRPQLHEYAHRACCQCRRDSVQTCGPVRLLPSMCCEEACSPNPATLGCGVHSAASLQARNAGPAGEMVPTFFGSLTQSICGEFSDAWPLMQNPMGGDNISFCDSYPELTGEDIHSLNPELESSTSLDSNSSQDLVGGAVPVQSHSENFTAATDLSRYNNTLVESASTQDALTMRSQLDQESGAVIHPATQTSLQEA

SEQ ID NO: 291 - DNA, 2395 bp, Homo sapiens
cctggagccggaagcgcggctgcagcagggcgaggctccaggtggggtcggttccgcatccagcctagcgtgtccacgatgcggctgggctccgggactttcgctacctgttgcgtagcgatcgaggtgctagggatcgcggtcttccttcggggattcttcccggctcccgttcgttcctctgccagagcggaacacggagcggagcccccagcgcccgaaccctcggctggagccagttctaactggaccacgctgccaccacctctcttcagtaaagttgttattgttctgatagatgccttgagagatgattttgtgtttgggtcaaagggtgtgaaatttatgccctacacaacttaccttgtggaaaaaggagcatctcacagttttgtggctgaagcaaagccacctacagttactatgcctcgaatcaaggcattgatgacggggagccttcctggctttgtcgacgtcatcaggaacctcaattctcctgcactgctggaagacagtgtgataagacaagcaaaagcagctggaaaaagaatagtcttttatggagatgaaacctgggttaaattattcccaaagcattttgtggaatatgatggaacaacctcatttttcgtgtcagattacacagaggtggataataatgtcacgaggcatttggataaagtattaaaaagaggagattgggacatattaatcctccactacctggggctggaccacattggccacatttcagggcccaacagccccctgattgggcagaagctgagcgagatggacagcgtgctgatgaagatccacacctcactgcagtcgaaggagagagagacgcctttacccaatttgctggttctttgtggtgaccatggcatgtctgaaacaggaagtcacggggcctcctccaccgaggaggtgaatacacctctgattttaatcagttctgcgtttgaaaggaaacccggtgatatccgacatccaaagcacgtccaatagacggatgtggctgcgacactggcgatagcacttggcttaccgattccaaaagacagtgtagggagcctcctattcccagttgtggaaggaagaccaatgagagagcagttgagatttttacatttgaatacagtgcagcttagtaaactgttgcaagagaatgtgccgtcatatgaaaaagatcctgggtttgagcagtttaaaatgtcagaaagattgcatgggaactggatcagactgtacttggaggaaaagcattcagaagtcctattcaacctgggctccaaggttctcaggcagtacctggatgctctgaagacgctgagcttgtccctgagtgcacaagtggcccagttctcaccctgctcctgctcagcgtcccacaggcactgcacagaaaggctgagctggaagtcccactgtcatctcctgggttttctctgctcttttatttggtgatcctggttctttcggccgttcacgtcattgtgtgcacctcagctgaaagttcgtgctacttctgtggcctctcgtggctggcggcaggctgcctttcgtttaccagactctggttgaacacctggtgtgtgccaagtgctggcagtgccctggacagggggcctcagggaaggacgtggagcagccttatcccaggcctctgggtgtcccgacacaggtgttcacatctgtgctgtcaggtcagatgcctcagttcttggaaagctaggttcctgcgactgttaccaaggtgattgtaaagagctggcggtcacagaggaacaagccccccagctgagggggtgtgtgaatcggacagcctcccagcagaggtgtgggagctgcagctgagggaagaagagacaatcggcctggacactcaggagggtcaaaaggagacttggtcgcaccactcatcctgccacccccagaatgcatcctgcctcatcaggtccagatttctttccaaggcggacgttttctgttggaattcttagtccttggcctcggacaccttcattcgttagctggggagtggtggtgaggcagtgaagaagaggcggatggtcacactcagatccacagagcccaggatcaagggacccactgcagtggcagcaggactgttgggcccccaccccaaccctgcacagccctcatcccctcttggcttgagccgtcagaggccctgtgctgagtgtctgaccgagacactcacagctttgtcatcagggcacaggcttcctcggagccaggatgatctgtgccacgcttgcacctcgggcccatctgggctcatgctctctctcctgctattgaattagtacctagctgcacacagtatgtagttaccaaaagaataaacggcaataattgagaaaaaaaa

SEQ ID NO: 292 - protein, 310 aa, Homo sapiens
MRLGSGTFATCCVAIEVLGIAVFLRGFFPAPVRSSARAEHGAEPPAPEPSAGASSNWTTLPPPLFSKVVIVLIDALRDDFVFGSKGVKFMPYTTYLVEKGASHSFVAEAKPPTVTMPRIKALMTGSLPGFVDVIRNLNSPALLEDSVIRQAKAAGKRIVFYGDETWVKLFPKHFVEYDGTTSFFVSDYTEVDNNVTRHLDKVLKRGDWDILILHYLGLDHIGHISGPNSPLIGQKLSEMDSVLMKIHTSLQSKERETPLPNLLVLCGDHGMSETGSHGASSTEEVNTPLILISSAFERKPGDIRHPKHVQ

SEQ ID NO: 293 - DNA, 918 bp, Homo sapiens
agccaggcagcacatcacagcgggaggagctgtcccaggtggcccagctcagcaatggcaatgggggtccccagagtcattctgctctgcctctttggggctgcgctctgcctgacagggtcccaagccctgcagtgctacagctttgagcacacctactttggcccctttgacctcagggccatgaagctgcccagcatctcctgtcctcatgagtgctttgaggctatcctgtctctggacaccgggtatcgcgcgccggtgaccctggtgcggaagggctgctggaccgggcctcctgcgggccagacgcaatcgaacccggacgcgctgccgccagactactcggtggtgcgcggctgcacaactgacaaatgcaacgcccacctcatgactcatgacgccctccccaacctgagccaagcacccgacccgccgacgctcagcggcgccgagtgctacgcctgtatcggggtccaccaggatgactgcgctatcggcaggtcccgacgagtccagtgtcaccaggaccagaccgcctgcttccagggcagtggcagaatgacagttggcaatttctcagtccctgtgtacatcagaacctgccaccggccctcctgcaccaccgagggcaccaccagcccctggacagccatcgacctccagggctcctgctgtgaggggtacctctgcaacaggaaatccatgacccagcccttcaccagtgcttcagccaccacccctccccgagcactacaggtcctggccctgctcctcccagtcctcctgctggtggggctctcagcatagaccgcccctccaggatgctggggacagggctcacacacctcattcttgctgcttcagcccctatcacatagctcactggaaaatgatgttaaagtaagaattgcaaaa

SEQ ID NO: 294 - protein, 251 aa, Homo sapiens [sequence omitted]

SEQ ID NO: 295 - DNA, 846 bp, Homo sapiens
aatcggctgattctgcatctggaaactgccttcatcttgaaagaaaagctccaggtcccttctccagccacccagccccaagatggtgatgctgctgctgctgctttccgcactggctggcctcttcggtgcggcagagggacaagcatttcatcttgggaagtgccccaatcctccggtgcaggagaattttgacgtgaataagtatctcggaagatggtacgaaattgagaagatcccaacaacctttgagaatggacgctgcatccaggccaactactcactaatggaaaacggaaagatcaaagtgttaaaccaggagttgagagctgatggaactgtgaatcaaatcgaaggtgaagccaccccagttaacctcacagagcctgccaagctggaagttaagttttcctggtttatgccatcggcaccgtactggatcctggccaccgactatgagaactatgccctcgtgtattcctgtacctgcatcatccaactttttcacgtggattttgcttggatcttggcaagaaaccctaatctccctccagaaacagtggactctctaaaaaatatcctgacttctaataacattgatgtcaagaaaatgacggtcacagaccaggtgaactgccccaagctctcgtaaccaggttctacagggaggctgcacccactccatgttacttctgcttcgctttcccctaccccaccccccccccataaagacaaaccaatcaaccacgacaaaggaagttgacctgaacatgtaaccatgccctaccctgttaccttgctagctgcaaaataaacttgttgctgacctgctgtgctcgcaaaaaa

SEQ ID NO: 296 - protein, 189 aa, Homo sapiens
MVMLLLLLSALAGLFGAAEGQAFHLGKCPNPPVQENFDVNKYLGRWYEIEKIPTTFENGRCIQANYSLMENGKIKVLNQELRADGTVNQIEGEATPVNLTEPAKLEVKFSWFMPSAPYWILATDYENYALVYSCTCIIQLFHVDFAWILARNPNLPPETVDSLKNILTSNNIDVKKMTVTDQVNCPKLS

SEQ ID NO: 297 - DNA, 1088 bp, Homo sapiens
gggtgattgaactaaaccttcgccgcaccgagtttgcagtacggccgtcacccgcaccgctgcctgcttgcggttggagaaatcaaggccctaccgggcctccgtagtcacctctctatagtgggcgtggccgaggccggggtgaccctgccggagcctccgctgccagcgacatgttcaaggtaattcagaggtccgtggggccagccagcctgagcttgctcaccttcaaagtctatgcagcaccaaaaaaggactcacctcccaaaaattccgtgaaggttgatgagctttcactctactcagttcctgagggtcaatcgaagtatgtggaggaggcaaggagccagcttgaagaaagcatctcacagctccgacactattgcgagccatacacaacctggtgtcaggaaacgtactcccaaactaagcccaagatgcaaagtttggttcaatgggggttagacagctatgactatctccaaaatgcacctcctggattttttccgagacttggtgttattggttttgctggccttattggactccttttggctagaggttcaaaaataaagaagctagtgtatccgcctggtttcatgggattagctgcctccctctattatccacaacaagccatcgtgtttgcccaggtcagtggggagagattatatgactggggtttacgaggatatatagtcatagaagatttgtggaaggagaactttcaaaagccaggaaatgtgaagaattcacctggaactaagtagaaaactccatgctctgccatcttaatcagttataggtaaacattggaaactccatagaataaatcagtatttctacagaaaaatggcatagaagtcagtattgaatgtattaaattggctttcttcttcaggaaaaactagaccagacctctgttatcttctgtgaaatcatcctacaagcaaactaacctggaatcccttcacctagagataatgtacaagccttagaactcctcattctcatgttgctatttatgtacctaattaaaacccaagtttaaaaaaaaaaaaaaaaaaaaaaaaaaaaaaaaaaaaaaa

SEQ ID NO: 298 - protein, 198 aa, Homo sapiens
MFKVIQRSVGPASLSLLTFKVYAAPKKDSPPKNSVKVDELSLYSVPEGQSKYVEEARSQLEESISQLRHYCEPYTTWCQETYSQTKPKMQSLVQWGLDSYDYLQNAPPGFFPRLGVIGFAGLIGLLLARGSKIKKLVYPPGFMGLAASLYYPQQAIVFAQVSGERLYDWGLRGYIVIEDLWKENFQKPGNVKNSPGTK

SEQ ID NO: 299 - DNA, 1328 bp, Homo sapiens
ccgctgagatgtacgaacttccggttctccgggcagctgccactgctgtagcttctgccacctgccacgaccgggcctctccctggcgtttggtcacctctgcttcattctccaccgcgcctatggtccctcttggagccagcgtggcgggcctggcggctcccgggtggtgagagagcggtccgggaacgatgaaggcctcgcagtgctgctgctgtctcagccacctcttggcttccgtcctcctcctgctgttgctgcctgaactaagcgggcccctggcagtcctgctgcaggcagccgaggccgcgccaggtcttgggcctcctgaccctagaccacggacattaccgccgctgccaccgggccctacccctgcccagcagccgggccgtggtctggctgaagctgcggggccgcggggctccgagggaggcaatggcagcaaccctgtggccgggcttgagacggacgatcacggagggaaggccggggaaggctcggtgggtggcggccttgctgtgagccccaaccctggcgacaagcccatgacccagcgggccctgaccgtgttgatggtggtgagcggcgcggtgctggtgtacttcgtggtcaggacggtcaggatgagaagaagaaaccgaaagactaggagatatggagttttggacactaacatagaaaatatggaattgacacctttagaacaggatgatgaggatgatgacaacacgttgtttgatgccaatcatcctcgaagataagaatgtgccttttgatgaaagaactttatctttctacaatgaagagtggaatttctatgtttaaggaataagaagccactatatcaatgttgggggggtatttaagttacatatattttaacaacctttaatttgctgttgcaataaataccgtatccttttattatatctttatatgtatagaagtactctattaatgggctcagagatgttggggataaagtatactgtaataatttatctgtttgaaaattactataaaacggtgttttctggtcggtttttgtttcctgcttaccatatgattgtaaattgttttatgtattaatcagttaatgctaattatttttgctgatgtcatatgttaaagagctataaattccaacaaccaactggtgtgtaaaaataatttaaaatttcctttactgaaaggtatttcccatttttgtggggaaaagaagccaaatttattactttgtgttggggtttttaaaatattaagaaatgtctaagttattgtttgcaaaacaataaatatgattttaaattctcttaaaaaaaaaa

SEQ ID NO: 300 - protein, 190 aa, Homo sapiens
MKASQCCCCLSHLLASVLLLLLLPELSGPLAVLLQAAEAAPGLGPPDPRPRTLPPLPPGPTPAQQPGRGLAEAAGPRGSEGGNGSNPVAGLETDDHGGKAGEGSVGGGLAVSPNPGDKPMTQRALTVLMVVSGAVLVYFVVRTVRMRRRNRKTRRYGVLDTNIENMELTPLEQDDEDDDNTLFDANHPRR

SEQ ID NO: 301 - DNA, 1470 bp, Homo sapiens
ctcggctggatttaaggttgccgctagccgcctgggaatttaagggacccacactaccttcccgaagttgaaggcaagcggtgattgtttgtagacggcgctttgtcatgggacctgtgcggttgggaatattgcttttcctttttttggccgtgcacgaggcttgggctgggatgttgaaggaggaggacgatgacacagaacgcttgcccagcaaatgcgaagtgtgtaagctgctgagcacagagctacaggcggaactgagtcgcaccggtcgatctcgagaggtgctggagctggggcaggtgctggatacaggcaagaggaagagacacgtgccttacagcgtttcagagacaaggctggaagaggccttagagaatttatgtgagcggatcctggactatagtgttcacgctgagcgcaagggctcactgagatatgccaagggtcagagtcagaccatggcaacactgaaaggcctagtgcagaagggggtgaaggtggatctggggatccctctggagctttgggatgagcccagcgtggaggtcacatacctcaagaagcagtgtgagaccatgttggaggagtttgaagacattgtgggagactggtacttccaccatcaggagcagcccctacaaaattttctctgtgaaggtcatgtgctcccagctgctgaaactgcatgtctacaggaaacttggactggaaaggagatcacagatggggaagagaaaacagaaggggaggaagagcaggaggaggaggaggaagaggaggaagaggaagggggagacaagatgaccaagacaggaagccaccccaaacttgaccgagaagatctttgacccttgcctttgagcccccaggaggggaagggatcatggagagccctctaaagcctgcactctccctgctccacagctttcagggtgtgtttatgagtgactccacccaagcttgtagctgttctctcccatctaacctcaggcaagatcctggtgaaacagcatgacatggcttctggggtggagggtgggggtggaggtcctgctcctagagatgaactctatccagccccttaattggcaggtgtatgtgctgacagtactgaaagctttcctctttaactgatcccacccccacccaaaagtcagcagtggcactggagctgtgggctttggggaagtcacttagctccttaaggtctgtttttagacccttccaaggaagaggccagaacggacattctctgcgatctatatacattgcctgtatccaggaggctacacaccagcaaaccgtgaaggagaatgggacactgggtcatggcctggagttgctgataatttaggtgggatagatacttggtctacttaagctcaatgtaacccagagcccaccatatagttttataggtgctcaactttctatatcgctattaaacttttttctttttttcta

SEQ ID NO: 302 - protein, 248 aa, Homo sapiens
MGPVRLGILLFLFLAVHEAWAGMLKEEDDDTERLPSKCEVCKLLSTELQAELSRTGRSREVLELGQVLDTGKRKRHVPYSVSETRLEEALENLCERILDYSVHAERKGSLRYAKGQSQTMATLKGLVQKGVKVDLGIPLELWDEPSVEVTYLKKQCETMLEEFEDIVGDWYFHHQEQPLQNFLCEGHVLPAAETACLQETWTGKEITDGEEKTEGEEEQEEEEEEEEEEGGDKMTKTGSHPKLDREDL

SEQ ID NO: 303 - DNA, 633 bp, Homo sapiens
ctcctgcactaggctctcagccagggatgatgcgctgctgccgccgccgctgctgctgccggcaaccaccccatgccctgaggccgttgctgttgctgcccctcgtccttttacctcccctggcagcagctgcagcgggcccaaaccgatgtgacaccatataccagggcttcgccgagtgtctcatccgcttgggggacagcatgggccgcggaggcgagctggagaccatctgcaggtcttggaatgacttccatgcctgtgcctctcaggtcctgtcaggctgtccggaggaggcagctgcagtgtgggaatcactacagcaagaagctcgccaggccccccgtccgaataacttgcacactctgtgcggtgccccggtgcatgttcgggagcgcggcacaggctccgaaaccaaccaggagacgctgcgggctacagcgcctgcactccccatggcccctgcgcccccactgctggcggctgctctggctctggcctacctcctgaggcctctggcctagcttgttgggttgggtagcagcgcccgtacctccagccctgctctggcggtggttgtccaggctctgcagagcgcagcagggcttttcattaaaggtatttatatttgta

SEQ ID NO: 304 - protein, 165 aa, Homo sapiens
MMRCCRRRCCCRQPPHALRPLLLLPLVLLPPLAAAAAGPNRCDTIYQGFAECLIRLGDSMGRGGELETICRSWNDFHACASQVLSGCPEEAAAVWESLQQEARQAPRPNNLHTLCGAPVHVRERGTGSETNQETLRATAPALPMAPAPPLLAAALALAYLLRPLA

SEQ ID NO: 305 - DNA, 890 bp, Homo sapiens
aagtacttgtgtccgggtggtggactggattagctgcggagccctggaagctgcctgtccttctccctgtgcttaaccagaggtgcccatgggttggacaatgaggctggtcacagcagcactgttactgggtctcatgatggtggtcactggagacgaggatgagaacagcccgtgtgcccatgaggccctcttggacgaggacaccctcttttgccagggccttgaagttttctacccagagttggggaacattggctgcaaggttgttcctgattgtaacaactacagacagaagatcacctcctggatggagccgatagtcaagttcccgggggccgtggacggcgcaacctatatcctggtgatggtggatccagatgcccctagcagagcagaacccagacagagattctggagacattggctggtaacagatatcaagggcgccgacctgaagaaagggaagattcagggccaggagttatcagcctaccaggctccctccccaccggcacacagtggcttccatcgctaccagttctttgtctatcttcaggaaggaaaagtcatctctctccttcccaaggaaaacaaaactcgaggctcttggaaaatggacagatttctgaaccgcttccacctgggcgaacctgaagcaagcacccagttcatgacccagaactaccaggactcaccaaccctccaggctcccagaggaagggccagcgagcccaagcacaaaaccaggcagagatagctgcctgctagatagccggctttgccatccgggcatgtggccacactgctcaccaccgacgatgtgggtatggaaccccctctggatacagaaccccttcttttccaaattaaaaaaaaaaatcatcaaa

SEQ ID NO: 306 - protein, 223 aa, Homo sapiens [sequence omitted]

SEQ ID NO: 307 - DNA, 924 bp, Homo sapiens
aaggagcagcccgcaagcaccaagtgagaggcatgaagttacagtgtgtttccctttggctcctgggtacaatactgatattgtgctcagtagacaaccacggtctcaggagatgtctgatttccacagacatgcaccatatagaagagagtttccaagaaatcaaaagagccatccaagctaaggacaccttcccaaatgtcactatcctgtccacattggagactctgcagatcattaagcccttagatgtgtgctgcgtgaccaagaacctcctggcgttctacgtggacagggtgttcaaggatcatcaggagccaaaccccaaaatcttgagaaaaatcagcagcattgccaactctttcctctacatgcagaaaactctgcggcaatgtcaggaacagaggcagtgtcactgcaggcaggaagccaccaatgccaccagagtcatccatgacaactatgatcagctggaggtccacgctgctgccattaaatccctgggagagctcgacgtctttctagcctggattaataagaatcatgaagtaatgttctcagcttgatgacaaggaacctgtatagtgatccagggatgaacaccccctgtgcggtttactgtgggagacagcccaccttgaaggggaaggagatggggaaggccccttgcagctgaaagtcccactggctggcctcaggctgtcttattccgcttgaaaataggcaaaaagtctactgtggtatttgtaataaactctatctgctgaaagggcctgcaggccatcctgggagtaaagggctgccttcccatctaatttattgtaaagtcatatagtccatgtctgtgatgtgagccaagtgatatcctgtagtacacattgtactgagtggtttttctgaataaattccatattttacctatga

SEQ ID NO: 308 - protein, 177 aa, Homo sapiens
MKLQCVSLWLLGTILILCSVDNHGLRRCLISTDMHHIEESFQEIKRAIQAKDTFPNVTILSTLETLQIIKPLDVCCVTKNLLAFYVDRVFKDHQEPNPKILRKISSIANSFLYMQKTLRQCQEQRQCHCRQEATNATRVIHDNYDQLEVHAAAIKSLGELDVFLAWINKNHEVMFSA

SEQ ID NO: 309 - DNA, 1321 bp, Homo sapiens
gtcgacccacgcgtccgaagctgctggagccacgattcagtcccctggactgtagataaagaccctttcttgccaggtgctgagacaaccacactatgagaggcactccaggagacgctgatggtggaggaagggccgtctatcaatcaatcactgttgctgttatcacatgcaagtatccagaggctcttgagcaaggcagaggggatcccatttatttgggaatccagaatccagaaatgtgtttgtattgtgagaaggttggagaacagcccacattgcagctaaaagagcagaagatcatggatctgtatggccaacccgagcccgtgaaacccttccttttctaccgtgccaagactggtaggacctccacccttgagtctgtggccttcccggactggttcattgcctcctccaagagagaccagcccatcattctgacttcagaacttgggaagtcatacaacactgcctttgaattaaatataaatgactgaactcagcctagaggtggcagcttggtctttgtcttaaagtttctggttcccaatgtgttttcgtctacattttcttagtgtcattttcacgctggtgctgagacaggagcaaggctgctgttatcatctcattttataatgaagaagaagcaattacttcatagcaactgaagaacaggatgtggcctcagaagcaggagagctgggtggtataaggctgtcctctcaagctggtgctgtgtaggccacaaggcatctgcatgagtgactttaagactcaaagaccaaacactgagctttcttctaggggtgggtatgaagatgcttcagagctcatgcgcgttacccacgatggcatgactagcacagagctgatctctgtttctgttttgctttattccctcttgggatgatatcatccagtctttatatgttgccaatatacctcattgtgtgtaatagaaccttcttagcattaagaccttgtaaacaaaaataattcttggggtgggtatgaagatgcttcagagctcatgcgcgttacccacgatggcatgactagcacagagctgatctctgtttctgttttgctttattccctcttgggatgatatcatccagtctttatatgttgccaatatacctcattgtgtgtaatagaaccttcttagcattaagaccttgtaaacaaaaataattcttgtgttaagttaaatcatttttgtcctaattgtaatgtgtaatcttaaagttaaataaactttgtgtatttatataataataaagctaaaactgatataaaataaagaaagagtaaactg

SEQ ID NO: 310 - protein, 134 aa, Homo sapiens
MRGTPGDADGGGRAVYQSITVAVITCKYPEALEQGRGDPIYLGIQNPEMCLYCEKVGEQPTLQLKEQKIMDLYGQPEPVKPFLFYRAKTGRTSTLESVAFPDWFIASSKRDQPIILTSELGKSYNTAFELNIND

SEQ ID NO: 311 - DNA, 999 bp, Homo sapiens
gcgaggctgcaccagcgcctggcaccatgaggacgcctgggcctctgcccgtgctgctgctgctcctggcgggagcccccgccgcgcggcccactcccccgacctgctactcccgcatgcgggccctgagccaggagatcacccgcgacttcaacctcctgcaggtctcggagccctcggagccatgtgtgagatacctgcccaggctgtacctggacatacacaattactgtgtgctggacaagctgcgggactttgtggcctcgcccccgtgttggaaagtggcccaggtagattccttgaaggacaaagcacggaagctgtacaccatcatgaactcgttctgcaggagagatttggtattcctgttggatgactgcaatgccttggaatacccaatcccagtgactacggtcctgccagatcgtcagcgctaagggaactgagaccagagaaagaacccaagagaactaaagttatgtcagctacccagacttaatgggccagagccatgaccctcacaggtcttgtgttagttgtatctgaaactgttatgtatctctctaccttctggaaaacagggctggtattcctacccaggaacctcctttgagcatagagttagcaaccatgcttctcattcccttgactcatgtcttgccaggatggttagatacacagcatgttgatttggtcactaaaaagaagaaaaggactaacaagcttcacttttatgaacaactattttgagaacatgcacaatagtatgtttttattactggtttaatggagtaatggtacttttattctttcttgatagaaacctgcttacatttaaccaagcttctattatgcctttttctaacacagactttcttcactgtctttcatttaaaaagaaattaatgctcttaagatatatattttacgtagtgctgacaggacccactctttcattgaaaggtgatgaaaatcaaataaagaatctcttcacatgga

SEQ ID NO: 312 - protein, 136 aa, Homo sapiens
MRTPGPLPVLLLLLAGAPAARPTPPTCYSRMRALSQEITRDFNLLQVSEPSEPCVRYLPRLYLDIHNYCVLDKLRDFVASPPCWKVAQVDSLKDKARKLYTIMNSFCRRDLVFLLDDCNALEYPIPVTTVLPDRQR

SEQ ID NO: 313 - DNA, 1162 bp, Homo sapiens
gagcgacgctgtctctagtcgctgatcccaaatgcaccggctcatctttgtctacactctaatctgcgcaaacttttgcagctgtcgggacacttctgcaaccccgcagagcgcatccatcaaagctttgcgcaacgccaacctcaggcgagatgacttgtaccgaagagatgagaccatccaggtgaaaggaaacggctacgtgcagagtcctagattcccgaacagctaccccaggaacctgctcctgacatggcggcttcactctcaggagaatacacggatacagctagtgtttgacaatcagtttggattagaggaagcagaaaatgatatctgtaggtatgattttgtggaagttgaagatatatccgaaaccagtaccattattagaggacgatggtgtggacacaaggaagttcctccaaggataaaatcaagaacgaaccaaattaaaatcacattcaagtccgatgactactttgtggctaaacctggattcaagatttattattctttgctggaagatttccaacccgcagcagcttcagagaccaactgggaatctgtcacaagctctatttcaggggtatcctataactctccatcagtaacggatcccactctgattgcggatgctctggacaaaaaaattgcagaatttgatacagtggaagatctgctcaagtacttcaatccagagtcatggcaagaagatcttgagaatatgtatctggacacccctcggtatcgaggcaggtcataccatgaccggaagtcaaaagttgacctggataggctcaatgatgatgccaagcgttacagttgcactcccaggaattactcggtcaatataagagaagagctgaagttggccaatgtggtcttctttccacgttgcctcctcgtgcagcgctgtggaggaaattgtggctgtggaactgtcaactggaggtcctgcacatgcaattcagggaaaaccgtgaaaaagtatcatgaggtattacagtttgagcctggccacatcaagaggaggggtagagctaagaccatggctctagttgacatccagttggatcaccatgaacgatgcgattgtatctgcagctcaagaccacctcgataagagaatgtgcacatccttacattaagcctgagagaa

SEQ ID NO: 314 - protein, 364 aa, Homo sapiens
MHRLIFVYTLICANFCSCRDTSATPQSASIKALRNANLRRDDLYRRDETIQVKGNGYVQSPRFPNSYPRNLLLTWRLHSQENTRIQLVFDNQFGLEEAENDICRYDFVEVEDISETSTIIRGRWCGHKEVPPRIKSRTNQIKITFKSDDYFVAKPGFKIYYSLLEDFQPAAASETNWESVTSSISGVSYNSPSVTDPTLIADALDKKIAEFDTVEDLLKYFNPESWQEDLENMYLDTPRYRGRSYHDRKSKVDLDRLNDDAKRYSCTPRNYSVNIREELKLANVVFFPRCLLVQRCGGNCGCGTVNWRSCTCNSGKTVKKYHEVLQFEPGHIKRRGRAKTMALVDIQLDHHERCDCICSSRPPR

SEQ ID NO: 315 - DNA, 2598 bp, Homo sapiens
cggctcgaggctcccgccaggagaaaggaacattctgaggggagtctacaccctgtggagctcaagatggtcctgagtggggcgctgtgcttccgaatgaaggactcggcattgaaggtgctttatctgcataataaccagcttctagctggagggctgcatgcagggaaggtcattaaaggtgaagagatcagcgtggtccccaatcggtggctggatgccagcctgtcccccgtcatcctgggtgtccagggtggaagccagtgcctgtcatgtggggtggggcaggagccgactctaacactagagccagtgaacatcatggagctctatcttggtgccaaggaatccaagagcttcaccttctaccggcgggacatggggctcacctccagcttcgagtcggctgcctacccgggctggttcctgtgcacggtgcctgaagccgatcagcctgtcagactcacccagcttcccgagaatggtggctggaatgcccccatcacagacttctacttccagcagtgtgactagggcaacgtgccccccagaactccctgggcagagccagctcgggtgaggggtgagtggaggagacccatggcggacaatcactctctctgctctcaggacccccacgtctgacttagtgggcacctgaccactttgtcttctggttcccagtttggataaattctgagatttggagctcagtccacggtcctcccccactggatggtgctactgctgtggaaccttgtaaaaaccatgtggggtaaactgggaataacatgaaaagatttctgtgggggtggggtgggggagtggtgggaatcattcctgcttaatggtaactgacaagtgttaccctgagccccgcaggccaacccatccccagttgagccttatagggtcagtagctctccacatgaagtcctgtcactcaccactgtgcaggagagggaggtggtcatagagtcagggatctatggcccttggcccagccccacccccttccctttaatcctgccactgtcatatgctacctttcctatctcttccctcatcatcttgttgtgggcatgaggaggtggtgatgtcagaagaaatggctcgagctcagaagataaaagataagtagggtatgctgatcctcttttaaaaacccaagatacaatcaaaatcccagatgctggtctctattcccatgaaaaagtgctcatgacatattgagaagacctacttacaaagtggcatatattgcaatttattttaattaaaagatacctatttatatatttctttatagaaaaaagtctggaagagtttacttcaattgtagcaatgtcagggtggtggcagtataggtgatttttcttttaattctgttaatttatctgtatttcctaatttttctacaatgaagatgaattccttgtataaaaataagaaaagaaattaatcttgaggtaagcagagcagacatcatctctgattgtcctcagcctccacttccccagagtaaattcaaattgaatcgagctctgctgctctggttggttgtagtagtgatcaggaaacagatctcagcaaagccactgaggaggaggctgtgctgagtttgtgtggctggaatctctgggtaaggaacttaaagaacaaaaatcatctggtaattctttcctagaaggatcacagcccctgggattccaaggcattggatccagtctctaagaaggctgctgtactggttgaattgtgtccccctcaaattcacatccttcttggaatctcagtctgtgagtttatttggagataaggtctctgcagatgtagttagttaagacaaggtcatgctggatgaaggtagacctaaattcaatatgactggtttccttgtatgaaaaggagaggacacagagacagaggagacgcggggaagactatgtaaagatgaaggcagagatcggagttttgcagccacaagctaagaaacaccaaggattgtggcaaccatcagaagcttggaagaggcaaagaagaattcttccctagaggctttagagggataacggctctgctgaaaccttaatctcagacttccagcctcctgaacgaagaaagaataaatttcggctgttttaagccaccaaggataattggttacagcagctctaggaaactaatacagctgctaaaatgatccctgtctcctcgtgtttacattctgtgtgtgtcccctcccacaatgtaccaaagttgtctttgtgaccaatagaatatggcagaagtgatggcatgccacttccaagattaggttataaaagacactgcagcttctacttgagccctctctctctgccacccaccgcccccaatctatcttggctcactcgctctgggggaagctagctgccatgctatgagcaggcctataaagagacttacgtggtaaaaaatgaagtctcctgcccacagccacattagtgaacctagaagcagagactctgtgagataatcgatgtttgttgttttaagttgctcagttttggtctaacttgttatgcagcaatagataaataatatgcagagaaagag

SEQ ID NO: 316 - protein, 155 aa, Homo sapiens
MVLSGALCFRMKDSALKVLYLHNNQLLAGGLHAGKVIKGEEISVVPNRWLDASLSPVILGVQGGSQCLSCGVGQEPTLTLEPVNIMELYLGAKESKSFTFYRRDMGLTSSFESAAYPGWFLCTVPEADQPVRLTQLPENGGWNAPITDFYFQQCD

SEQ ID NO: 317 - DNA, 663 bp, Homo sapiens
atggaacttggacttggaggcctctccacgctgtcccactgcccctggcctaggcggcagcctgccctgtggcccaccctggccgctctggctctgctgagcagcgtcgcagaggcctccctgggctccgcgccccgcagccctgccccccgcgaaggccccccgcctgtcctggcgtcccccgccggccacctgccggggggacgcacggcccgctggtgcagtggaagagcccggcggccgccgccgcagccttctcggcccgcgcccccgccgcctgcacccccatctgctcttccccgcgggggccgcgcggcgcgggctgggggcccgggcagccgcgctcgggcagcgggggcgcggggctgccgcctgcgctcgcagctggtgccggtgcgcgcgctcggcctgggccaccgctccgacgagctggtgcgtttccgcttctgcagcggctcctgccgccgcgcgcgctctccacacgacctcagcctggccagcctactgggcgccggggccctgcgaccgcccccgggctcccggcccgtcagccagccctgctgccgacccacgcgctacgaagcggtctccttcatggacgtcaacagcacctggagaaccgtggaccgcctctccgccaccgcctgcggctgcctgggctga

SEQ ID NO: 318 - protein, 220 aa, Homo sapiens
MELGLGGLSTLSHCPWPRRQPALWPTLAALALLSSVAEASLGSAPRSPAPREGPPPVLASPAGHLPGGRTARWCSGRARRPPPQPSRPAPPPPAPPSALPRGGRAARAGGPGSRARAAGARGCRLRSQLVPVRALGLGHRSDELVRFRFCSGSCRRARSPHDLSLASLLGAGALRPPPGSRPVSQPCCRPTRYEAVSFMDVNSTWRTVDRLSATACGCLG

SEQ ID NO: 319 - DNA, 1049 bp, Homo sapiens
gttgctatgttgcccaggctggtcttgaagtgccttgacctcctaaagtgttggaaccacagacgtgagccactccacccagcctaaaacttcatcttctttggatgagatgaacacttttaacaagagaacaggactctatataaatcgctgtgggctcaccacctctaaggaggagcactgactgaagacagaaaaattgatgaactgaagaagacatggtccattatgccttacaaacttacacagtgctttgggaattccaaagtactcagtggagagaggtgtttcaggagccgtagagccagatcgtcatcatgtctgcattgtggctgctgctgggcctccttgccctgatggacttgtctgaaagcagcaactggggatgctatggaaacatccaaagcctggacacccctggagcatcttgtgggattggaagacgtcacggcctgaactactgtggagttcgtgcttctgaaaggctggctgaaatagacatgccatacctcctgaaatatcaacccatgatgcaaaccattggccaaaagtactgcatggatcctgccgtgatcgctggtgtcttgtccaggaagtctcccggtgacaaaattctggtcaacatgggcgataggactagcatggtgcaggaccctggctctcaagctcccacatcctggattagtgagtctcaggtttcccagacaactgaagttctgactactagaatcaaagaaatccagaggaggtttccaacctggacccctgaccagtacctgagaggtggactctgtgcctacagtgggggtgctggctatgtccgaagcagccaggacctgagctgtgacttctgcaatgatgtccttgcacgagccaagtacctcaagagacatggcttctaacatctcagatgaaacccaagaccatgatcacatatgcagcctcaaatgttacacagataaaactagccaagggcacctgtaactgggaatctgagtttgacctaaaagtcattaaaataacatgaatcccattaaaaaaaaaaaaaa

SEQ ID NO: 320 - protein, 194 aa, Homo sapiens
MSALWLLLGLLALMDLSESSNWGCYGNIQSLDTPGASCGIGRRHGLNYCGVRASERLAEIDMPYLLKYQPMMQTIGQKYCMDPAVIAGVLSRKSPGDKILVNMGDRTSMVQDPGSQAPTSWISESQVSQTTEVLTTRIKEIQRRFPTWTPDQYLRGGLCAYSGGAGYVRSSQDLSCDFCNDVLARAKYLKRHGF

SEQ ID NO: 321 - DNA, 1820 bp, Homo sapiens
gccttataaagtagcctctgcatctgcctgcctcgggcagaggagggctaccctggggctgagagttcacctgtctcaggaaccacctgagcccacagatcctgtgggcagcggccagggcagccatggcttgggcaagtaggctgggcctgctgctggcactgctgctgcccgtggtcggtgcctccacgccaggcaccgtggtccgactcaacaaggcagcattgagctacgtgtctgaaattgggaaagcccctctccagcgggccctgcaggtcactgtccctcatttcctggactggagtggagaggcgcttcagcccaccaggatccggattctgaatgtccatgtgccccgcctccacctgaaattcattgctggtttcggagtgcgcctgctggcagcagctaattttactttcaaggtctttcgcgccccagagcccctggagctgacgctgcctgtggaactgctggctgacacccgcgtgacccagagctccatcaggacccctgtggtcagcatctctgcctgctctttattctcgggccacgccaacgagtttgatggcagtaacagcacctcccacgcgctgctggtcctggtgcagaagcacattaaagctgtcttgagtaacaagctgtgcctgagcatctccaacctggtgcagggtgtcaatgtccacctgggcaccttaattggcctcaaccccgtgggtcctgagtcccagatccgctattccatggtcagtgtgcccactgtcaccagtgactacatttccctggaagtcaatgctgttctcttcctgctgggcaaccccatcatcctgcccacggatgccaccccttttgtgttgccaaggcatgtgggtaccgagggctccatggccaccgtgggcctctcccagcagctgtttgactctgcgctcctgctgctgcagaaggccggtgccctcaacctggacatcacagggcagctgaggtcggatgacaacctgctgaacacctctgctctgggccggctcatcccggaggtggcccgccagtttcccgagcccatgcctgtggtgctcaaggtgcggctgggtgccacacctgtggccatgctccacacaaacaacgccaccctgcggctgcagcccttcgtggaggtcctggccacagcctccaactcggctttccagtccctcttctccctggatgtggtagtgaacttgagactccagctctctgtgtccaaggtgaagcttcaggggaccacgtctgtgctgggggatgtccagctcacggtggcctcctccaacgtgggcttcattgatacagatcaggtgcgcacactgatgggcaccgtttttgagaagcccctgctggaccatctcaatgctctcttggccatgggaattgccctccctggtgtggtcaacctccactatgttgcccctgagatctttgtctatgagggctacgtggtgatatccagtggactcttctaccagagctgaggcaagaccactgggaggcctgagagtgggccagctcgctgctcaggcgaatttctcatttcaagccactggggaaactgaggcaaaaccatacttagtcatcaccaacaagctggactgcttagctgggctgttttatcttccctgagtgcctgggtctccctccctcacttctgccctttcccttcctcctcctcttctcctccctcttccctcatctcccccctccttcctctgccccaccccaggggggagcagactgctcctccaggctgtatagacctgccctcttgcattaaacaacttctcttgagctgc

SEQ ID NO: 322 - protein, 458 aa, Homo sapiens [sequence omitted]

SEQ ID NO: 323 - DNA, 899 bp, Homo sapiens
ttgaaaatctactctatcagctgctgtggttgccaccattctcaggaccctcgccatgaaagcccttatgctgctcaccctgtctgttctgctctgctgggtctcagctgacattcgctgtcactcctgctacaaggtccctgtgctgggctgtgtggaccggcagtcctgccgcctggagccaggacagcaatgcctgacaacacatgcataccttggtaagatgtgggttttctccaatctgcgctgtggcacaccagaagagccctgtcaggaggccttcaaccaaaccaaccgcaagctgggtctgacatataacaccacctgctgcaacaaggacaactgcaacagcgcaggaccccggcccactccagccctgggccttgtcttccttacctccttggctggccttggcctctggctgctgcactgagactcattccattggctgcccctcctcccacctgccttggcctgagcctctctccctgtgtctctgtatcccctggctttacagaatcgtctctccctagctcccatttctttaattaaacactgttccgagtggtctcctcatccatccttcccacctcacacccttcactctcctttttctgggtcccttcccacttccttccaggacctccattggctcctagaagggctccccactttgcttcctatactctgctgtcccctacttgaggagggattgggatctgggcctgaaatggggcttctgtgttgtccccagtgaaggctcccacaaggacctgatgacctcactgtacagagctgactccccaaacccaggctcccatatgtaccccatcccccatactcacctctttccattttgagtaataaatgtctgagtctggaaaaaaaaaaaaaaaaaa

SEQ ID NO: 324 - protein, 125 aa, Homo sapiens
MKALMLLTLSVLLCWVSADIRCHSCYKVPVLGCVDRQSCRLEPGQQCLTTHAYLGKMWVFSNLRCGTPEEPCQEAFNQTNRKLGLTYNTTCCNKDNCNSAGPRPTPALGLVFLTSLAGLGLWLLH

SEQ ID NO: 325 - DNA, 1977 bp, Homo sapiens
acgggccgcagcggcagtgacgtagggttggcgcacggatccgttgcggctgcagctctgcagtcgggccgttccttcgccgccgccaggggtagcggtgtagctgcgcagcgtcgcgcgcgctaccgcacccaggttcggcccgtaggcgtctggcagcccggcgccatcttcatcgagcgccatggccgcagcctgcgggccgggagcggccgggtactgcttgctcctcggcttgcatttgtttctgctgaccgcgggccctgccctgggctggaacgaccctgacagaatgttgctgcgggatgtaaaagctcttaccctccactatgaccgctataccacctcccgcaggctggatcccatcccacagttgaaatgtgttggaggcacagctggttgtgattcttataccccaaaagtcatacagtgtcagaacaaaggctgggatgggtatgatgtacagtgggaatgtaagacggacttagatattgcatacaaatttggaaaaactgtggtgagctgtgaaggctatgagtcctctgaagaccagtatgtactaagaggttcttgtggcttggagtataatttagattatacagaacttggcctgcagaaactgaaggagtctggaaagcagcacggctttgcctctttctctgattattattataagtggtcctcggcggattcctgtaacatgagtggattgattaccatcgtggtactccttgggatcgcctttgtagtctataagctgttcctgagtgacgggcagtattctcctccaccgtactctgagtatcctccattttcccaccgttaccagagattcaccaactcagcaggacctcctcccccaggctttaagtctgagttcacaggaccacagaatactggccatggtgcaacttctggttttggcagtgcttttacaggacaacaaggatatgaaaattcaggaccagggttctggacaggcttgggaactggtggaatactaggatatttgtttggcagcaatagagcggcaacacccttctcagactcgtggtactacccgtcctatcctccctcctaccctggcacgtggaatagggcttactcaccccttcatggaggctcgggcagctattcggtatgttcaaactcagacacgaaaaccagaactgcatcaggatatggtggtaccaggagacgataaagtagaaagttggagtcaaacactggatgcagaaattttggatttttcatcactttctctttagaaaaaaagtactacctgttaacaattgggaaaaggggatattcaaaagttctgtggtgttatgtccagtgtagctttttgtattctattatttgaggctaaaagttgatgtgtgacaaaatacttatgtgttgtatgtcagtgtaacatgcagatgtatattgcagtttttgaaagtgatcattactgtggaatgctaaaaatacattaatttctaaaacctgtgatgccctaagaagcattaagaatgaaggtgttgtactaatagaaactaagtacagaaaatttcagttttaggtggttgtagctgatgagttattacctcatagagactataatattctatttggtattatattatttgatgtttgctgttcttcaaacatttaaatcaagctttggactaattatgctaatttgtgagttctgatcacttttgagctctgaagctttgaatcattcagtggtggagatggccttctggtaactgaatattaccttctgtaggaaaaggtggaaaataagcatctagaaggttgttgtgaatgactctgtgctggcaaaaatgcttgaaacctctatatttctttcgttcataagaggtaaaggtcaaatttttcaacaaaagtcttttaataacaaaagcatgcagttctctgtgaaatctcaaatattgttgtaatagtctgtttcaatcttaaaaagaatca

SEQ ID NO: 326 - protein, 339 aa, Homo sapiens
MAAACGPGAAGYCLLLGLHLFLLTAGPALGWNDPDRMLLRDVKALTLHYDRYTTSRRLDPIPQLKCVGGTAGCDSYTPKVIQCQNKGWDGYDVQWECKTDLDIAYKFGKTVVSCEGYESSEDQYVLRGSCGLEYNLDYTELGLQKLKESGKQHGFASFSDYYYKWSSADSCNMSGLITIVVLLGIAFVVYKLFLSDGQYSPPPYSEYPPFSHRYQRFTNSAGPPPPGFKSEFTGPQNTGHGATSGFGSAFTGQQGYENSGPGFWTGLGTGGILGYLFGSNRAATPFSDSWYYPSYPPSYPGTWNRAYSPLHGGSGSYSVCSNSDTKTRTASGYGGTRRR

SEQ ID NO: 327 - DNA, 840 bp, Homo sapiens
ggcacgaggtggaagggcttttacaaacagattgctggccccaccccccagaatttctcatcaggagtgggcaagaccaatcatttgcatttctgacaagttcccaggagctgcagctgctggccctggaaccacactttgagaaccactgctttagaccaaacaccaaaggaagatgcagccaccctcctttacatgtcacaacgctcagggtccatgagtacctcaggctgtccagctgagctccacctgcagcagccgagattcccgactcgctccaccattgggggctaggagtgaagcgtgtcaccatggtcagctcatggccagccaggaaagcctctctgctgtgcgtctgtgcagttcttgttcttccctggaggactcttggatcgcctgtgatcttggccaggagaccaggtgcctgggtcccttcctggaaggggacaagttacacaccccagccccattttcccaccaacttctacatgccttgggagaaccttctacatgttggctgcccccttcccctatttcagcagtgcccagtcctgcttataaacctgaggcctgctccccataccttccctgtgcaagtgccagccgttattccaggcagcccaatgttgttgaggccagatggattcctggaagcagctggcccatggatgtgagtcatcacagtattctagaaacagagaagaggtcttaacctaatgcgcatagagaaattgttctcattgtaaacatacccctgtccttagctgatctaggtggaagcccagcttcatgtgctagggggcatgataatgataataaaggaattgtatctaggactaa

SEQ ID NO: 328 - protein, 120 aa, Homo sapiens [sequence omitted]

SEQ ID NO: 329 - DNA, 771 bp, Homo sapiens
caaagagtagtcagtcccttcttggctctgctgacactcgagcccacattccatcacctgctcccaatcatgcaggtctccactgctgcccttgccgtcctcctctgcaccatggctctctgcaaccaggtcctctctgcaccacttgctgctgacacgccgaccgcctgctgcttcagctacacctcccgacagattccacagaatttcatagctgactactttgagacgagcagccagtgctccaagcccagtgtcatcttcctaaccaagagaggccggcaggtctgtgctgaccccagtgaggagtgggtccagaaatacgtcagtgacctggagctgagtgcctgaggggtccagaagcttcgaggcccagcgacctcagtgggcccagtggggaggagcaggagcctgagccttgggaacatgcgtgtgacctctacagctacctcttctatggactggttattgccaaacagccacactgtgggactcttcttaacttaaattttaatttatttatactatttagtttttataatttatttttgatttcacagtgtgtttgtgattgtttgctctgagagttccccctgtcccctcccccttccctcacagtgtgtctggtgacaaccgagtggctgtcatcggcctgtgtaggcagtcatggcaccaaagccaccagactgacaaatgtgtatcaaatgcttttgttcagggctgtgatcggcctggggaaataataaagatgttcttttaaacggtaaaaaa

SEQ ID NO: 330 - protein, 93 aa, Homo sapiens
MQVSTAALAVLLCTMALCNQVLSAPLAADTPTACCFSYTSRQIPQNFIADYFETSSQCSKPSVIFLTKRGRQVCADPSEEWVQKYVSDLELSA

SEQ ID NO: 331 - DNA, 1557 bp, Homo sapiens
ggcacgaggtgagactttaaatgaaatgtctcacaagctaggtgatccaggttttgtggtctttgcaacccttgtggtcattgtggccttgatattaatcttcgtggtgggtcctcgccatggacagacaaacattcttgtgtacataacaatctgctctgtaatcggcgcgttttcagtctcctgtgtgaagggcctgggcattgctatcaaggagctgtttgcagggaagcctgtgctgcggcatcccctggcttggattctgctgctgagcctcatcgtctgtgtgagcacacagattaattacctaaatagggccctggatatattcaacacttccattgtgactccaatatattatgtattctttacaacatcagttttaacttgttcagctattctttttaaggagtggcaagatatgcctgttgacgatgtcattggtactttgagtggcttctttacaatcattgtggggatattcttgttgcatgcctttaaagacgtcagctttagtctagcaagtctgcctgtgtcttttcgaaaagacgagaaagcaatgaatggcaatctctctaatatgtatgaagttcttaataataatgaagaaagcttaacctgtggaatcgaacaacacactggtgaaaatgtctcccgaagaaatggaaatctgacagctttttaagaaaggtgtaattaaaggttaatctgtgattgttatgaagtgaatttgaatatcatcagaatgtgtctgaaaaaacattgtcctcaaataatgttctttaaaggcaatctttttaaagatttcactaatttggaccaagaaattacttttcttgtatttaaacaaacaatggtagctcactaaaatgacctcagcacatgacgatttctattaacattttattgttgtagaagtattttacattttcatcccttctccaaaagccgaatgcactaatgacagttttaagtctatgaaaatgctttattttttcattggtgatgaaagtctgaaatgtgcatttgtcatccccactccatcaatccctgaccatgtaaggcttttttattttaaaaaaacagagttatcccaatacattatcctgtgatttaccttacctacaaaagtggctcctgtttgtttgatgatgattggttttatttttgaaatatttattaagggaaaactaagttactgaatgaaggaacctctttcttacaaaacaaaaaaaagggcagaaatcaccccaaggaacgatttctcaggttgagatgatcaccgtgaatccggcttcctctgagcattcgatggccttagcacctcatcaagccagcacatcctgcctgctgttgcagcctggctgggtttattcttcagttaccctaatcccatgatgcctggaaccttgattaccgttttacatcagctcttgtacttttcagtatattttcataatgagttatattgtcatttagactttgaacagctctgggaaatagaagactagggttgtttcttaaatttagctcatgttataataaaaagttgaaatg

SEQ ID NO: 332 - protein, 219 aa, Homo sapiens [sequence omitted]

SEQ ID NO: 333 - DNA, 1081 bp, Homo sapiens
gtgatggcggctggtgatggggacgtgaagctaggcaccctggggagtggcagcgagagcagcaacgacggcggcagcgagagtccaggcgacgcgggagcggcagcggaagggggaggctgggcggcggcggcgttggcgcttctgacggggggcggggaaatgctgctgaacgtggcgctggtggctctggtgctgctgggggcctaccggctgtgggtgcgctgggggcggcggggtctgggggccggggccggggcgggcgaggagagccccgccacctctctgcctcgcatgaagaagcgggacttcagcttggagcagctgcgccagtacgacggctcccgcaacccgcgcatcctgctcgcggtcaatgggaaagtcttcgacgtgaccaaaggcagcaagttctacggcccggcgggtccatatggaatatttgctggtagggatgcctccagaggactggccacattttgcctagataaagatgcacttagagatgaatatgatgatctctcagatttgaatgcagtacaaatggagagtgttcgagaatgggaaatgcagtttaaagaaaaatatgattatgtaggcagactcctaaaaccaggagaagaaccatcagaatatacagatgaagaagataccaaggatcacaataaacaggattgaactttgtaaacaaccaaagtcaggggccttcagaactgcaattcttactccctttcacagactgtccggagtctttgggtttgattcacctgctgcgaaaaacattcaacaaattgtgtacaagataaattaatctcactatgaagatttgaataactagacattatttatgctgccaaactcatttgttgcagttgtttgtaatgtctagtggggcttcatcatcctgaaaagaaggagacagggatttttttaaagagcaagaaagtcacaatattacttctttccttccttttttccttctttcctttcttctttctctttctttctttttaaaatatattgaagacaaccagatatgtatttgctactcaagtgtacagatctcctcaagaaacatcaaggg

SEQ ID NO: 334 - protein, 223 aa, Homo sapiens
MAAGDGDVKLGTLGSGSESSNDGGSESPGDAGAAAEGGGWAAAALALLTGGGEMLLNVALVALVLLGAYRLWVRWGRRGLGAGAGAGEESPATSLPRMKKRDFSLEQLRQYDGSRNPRILLAVNGKVFDVTKGSKFYGPAGPYGIFAGRDASRGLATFCLDKDALRDEYDDLSDLNAVQMESVREWEMQFKEKYDYVGRLLKPGEEPSEYTDEEDTKDHNKQD

SEQ ID NO: 335 - DNA, 2814 bp, Homo sapiens
gacaggccggggttactgtggcgaccacgagagcagctttggcgctatggaggagcccggggctacccctcaaccgtatttggggctgctcctggaggagctacgcagggttgtggcagcactgcctgaaggtatgagaccagattctaatctttatggttttccatgggaattggtgatatgtgcagctgttgttggattttttgctgttctcttttttttgtggagaagttttagatcggttaggagtcggctttatgtgggacgagagaaaaagcttgctctaatgctttctggactaattgaagaaaaaagtaaactacttgaaaaatttagccttgttcaaaaagagtatgaaggctatgaagtagagtcatctttaaaggatgccagctttgagaaggaggcaacagaagcacaaagtttggaggcaacctgtgaaaagctgaacaggtccaattctgaacttgaggatgaaatactctgtctagaaaaagagttaaaagaagagaaatccaaacattctgaacaagatgaattgatggcggatatttcaaaaaggatacagtctctagaagatgagtcaaaatccctcaaatcacaagtagctgaagccaaaatgaccttccagatatttcaaatgaatgaagaacgactgaagatagcaataaaagatgctttgaatgaaaattctcaacttcaggaaagccagaaacagcttttgcaagaagctgaagtatggaaagaacaagtgagtgaacttaataaacagaaagtaacatttgaagactccaaagtacatgcagaacaagttctaaatgataaagaaagtcacatcaagactctgactgaacgcttgttaaagatgaaagattgggctgctatgcttggagaagacataacggatgatgataacttggaattagaaatgaacagtgaatcggaaaatggtgcttacttagataatcctccaaaaggagctttgaagaaactgattcatgctgctaagttaaatgcttctttaaaaaccttagaaggagaaagaaaccaaatttatattcagttgtctgaagttgataaaacaaaggaagagcttacagagcatattaaaaatcttcagactcaacaagcatctttgcagtcagaaaacacacattttgaaaatgagaatcagaagcttcaacagaaacttaaagtaatgactgaattatatcaagaaaatgaaatgaaactccacaggaaattaacagtagaggaaaattatcggttagagaaagaagagaaactttctaaagtagatgaaaagatcagccatgccactgaagagctggagacctatagaaagcgagccaaagatcttgaagaagaattggagagaactattcattcttatcaagggcagattatttcccatgagaaaaaagcacatgataattggttggcagctcggaatgctgaaagaaacctcaatgatttaaggaaagaaaatgctcacaacagacaaaaattaactgaaacagagcttaaatttgaacttttagaaaaagatccttatgcactcgatgttccaaatacagcatttggcagaggctcacgaggcccagggaatcctctggaccatcagattaccaatgaaagaggagaatcaagctgtgataggttaaccgatcctcatagggctccctctgacactgggtctctgtcacctccatgggaccaggaccgtaggatgatgtttcctccgccaggacaatcatatcctgattcagcccttcctccacaaaggcaagacagattttgttctaattctggtagactgtctggaccagcagaactcagaagttttaatatgccttctttggataaaatggatgggtcaatgccttcagaaatggaatccagtagaaatgataccaaagatgatcttggtaatttaaatgtgcctgattcatctctccctgctgaaaatgaagccactggccctggctttgttcctccacctcttgctccaatcagaggtccattgtttccagtggatgcaagaggcccattcttgagaagaggacctcctttccccccacctcctccaggagccatgtttggagcttctcgagattattttccaccaagggatttcccaggtccaccacctgctccatttgcaatgagaaatgtctatccaccgaggggttttcctccttaccttcccccaagacctggatttttccccccacccccacattctgaaggtagaagtgagttcccctcaggtttgattccaccttcaaatgagcctgctactgaacatccagaaccacagcaagaaacctgacaatatttttgctctcttcaaaagtaattttgactgatctcattttcagtttaagtaactgctgttacttaagtgattacacttttgctcaaattgaagcttaatggaattataattctcaggatagtattttgtaaataaagatgatttaaatatgaatcttatgagtaaattatttcaattttattttagacggtataactatttcaatttgattaatccactattatataaacaatagtgggagttttatatatgtaatctttcaggtggggaggctttaaattctgaagtctgtgtctttatgccaagaactgtatttactgtggttgtggacaaatgtgaaagtaactttatgcttaaataaattatagttgatttaaagatttgtttggcattgataataataaaatcagtagtttttctataaaaaaaaaaaaaaaaaaaaaaaaaaaaaaaaaaaaaaaaaaaaaaaaaaaaaa

SEQ ID NO: 336 - protein, 776 aa, Homo sapiens
TGRGYCGDHESSFGAMEEPGATPQPYLGLLLEELRRVVAALPEGMRPDSNLYGFPWELVICAAVVGFFAVLFFLWRSFRSVRSRLYVGREKKLALMLSGLIEEKSKLLEKFSLVQKEYEGYEVESSLKDASFEKEATEAQSLEATCEKLNRSNSELEDEILCLEKELKEEKSKHSEQDELMADISKRIQSLEDESKSLKSQVAEAKMTFQIFQMNEERLKIAIKDALNENSQLQESQKQLLQEAEVWKEQVSELNKQKVTFEDSKVHAEQVLNDKESHIKTLTERLLKMKDWAAMLGEDITDDDNLELEMNSESENGAYLDNPPKGALKKLIHAAKLNASLKTLEGERNQIYIQLSEVDKTKEELTEHIKNLQTQQASLQSENTHFENENQKLQQKLKVMTELYQENEMKLHRKLTVEENYRLEKEEKLSKVDEKISHATEELETYRKRAKDLEEELERTIHSYQGQIISHEKKAHDNWLAARNAERNLNDLRKENAHNRQKLTETELKFELLEKDPYALDVPNTAFGRGSRGPGNPLDHQITNERGESSCDRLTDPHRAPSDTGSLSPPWDQDRRMMFPPPGQSYPDSALPPQRQDRFCSNSGRLSGPAELRSFNMPSLDKMDGSMPSEMESSRNDTKDDLGNLNVPDSSLPAENEATGPGFVPPPLAPIRGPLFPVDARGPFLRRGPPFPPPPPGAMFGASRDYFPPRDFPGPPPAPFAMRNVYPPRGFPPYLPPRPGFFPPPPHSEGRSEFPSGLIPPSNEPATEHPEPQQET

SEQ ID NO: 337 - DNA, 2997 bp, Homo sapiens
ggactgcggtctcgggcagcaatggccgagaagcgcgacacacgggactccgaagcccagcggctccccgactccttcaaggacagccccagtaagggccttggaccttgcggatggattttggtggcgttctcattcttattcaccgttataactttcccaatctcaatatggatgtgcataaagattataaaagagtatgaaagagccatcatctttagattgggtcgcattttacaaggaggagccaaaggacctggtttgttttttattctgccatgcactgacagcttcatcaaagtggacatgagaactatttcatttgatattcctcctcaggagatcctgacaaaggattcagtgacaattagcgtggatggtgtggtctattaccgcgttcagaatgcaaccctggctgtggcaaatatcaccaacgctgactcagcaacccgtcttttggcacaaactactctgaggaatgttctgggcaccaagaatctttctcagatcctctctgacagagaagaaattgcacacaacatgcagtctactctggatgatgccactgatgcctggggaataaaggtggagcgtgtggaaattaaggatgtgaaactacctgtgcagctccagagagctatggctgcagaagcagaagcgtcccgcgaggcccgcgccaaggttattgcagccgaaggagaaatgaatgcatccagggctctgaaagaagcctccatggtcatcactgaatctcctgcagcccttcagctccgatacctgcagacactgaccaccattgctgctgagaaaaactcaacaattgtcttccctctgcccatagatatgctgcaaggaatcataggggcaaaacacagccatctaggctagtgtagagatgagcgctagccttccaagcatgaagtcggggaccaaattagcctttaactcataaagagagggtagggcttttctttttccatatgtcaattgtggtgttcccagaatgtatagcagttataaaaataggtgaaagaattgttagcttgtaaatactgagagattggtgatttatataaggtaatctgttagtcttaaaatagttaaaagtttgtatttttagattattatgtagtaggttagatccctcttgttttgacttccactgactcattctgaaccccctaagcacccaggccacaggcaagaacctgggctgtaactgccacctgacaccgctgactggctaaatgctttgcagaaagtgatgaccttacaccacaaccagcttctccaggtcatatgtgccttacctccagaagtctttttttttttttttttctgagatggagtttcactcttgttgcccaggctggagtgcaatagcatgatctcggctcactgcaacctccgcctcctgggttcaagagattctcctgcctcagcctccccagtagctgggattacaggctcatgccaccatgcccagctaatttttgtattattattattgttttttagtagagacggggtttcaccatgttggccaggctagtcacgaactcctaacctcaggtgatccacccacctctgcctccaaagtgctggattacaggctgagctaccaccctggtttggagagtcttaattaattgaaatttccctaatgttcatttattttctaaatccagccgtgtttcagaataatccttacttgagagtagccattttcttgtgtacttgtcagaactagaggaaatagccaagactaatgaaaaacattactctaacccttaaaagacttttaaattcactactagagtggtcattttaaaaatacatccatgttttaacttattttgagcctttcttttatgagtaaatgattcctccttgttctgtctttcaaaccagctaaatatttgtcacaaaagtgacttttttctcactgttgcctattttcatatatcaggttttaaatagttttaattttttaataaaatttttctctacgttctatatgcaattgttatatatctatttgaatagctgaaggactaaaatacttttttaagagataacttcaggaaaccattatattttactatctgcatgctgttaactgtggtacactgtgaaatatgttgattacaaacccattcattacatagtataaggaattcacagtatattgactatatagtgtctaatgactgggcagatactgtcaacttacaatatctatatagagaggctttaaacttaccttactcattctctatgatgtatgacttgatgctgaaagaggaagctggtcagctcctcatggacaacaaattcttagtctataatattaggagacatctctagttttgcaaatgtctgtgaatctgagcaacctggacttctgcttactggccagaaagctggcgggtgacatttgtaacatttcctctttgagactctgagttcacctagagaagtctaagcataacagctttctttcccagcacgagcctttatagctctctttagctcaaccactctgtccatccagccaatggatgtccttccctgtacccaattcaagcttattttagggaagccttgaaactaccatgtatctggctctagctgagttattgaggattgagccagtgcaacgttaaactcagtgcacttacatttgatttaaatgatggttttatctgttgtgtgaagtggttcacccttgaggaccaggagcctccatatcctgactgaaaaccttttctgagacttagagtaacagtacttttggttccttgagttctcctgtctccagatacctaaatgaccttgacttttctgccttgtgaattcgtagtccaatcagctgaaattaaatcacttgggagggacgcatagaaggagctctaggaacacagtgccagtgcagaagtttctccaggtggcctccctttccaacaatgtacataataaagtgtatgcactttcact

SEQ ID NO: 338 - protein, 288 aa, Homo sapiens
MAEKRDTRDSEAQRLPDSFKDSPSKGLGPCGWILVAFSFLFTVITFPISIWMCIKIIKEYERAIIFRLGRILQGGAKGPGLFFILPCTDSFIKVDMRTISFDIPPQEILTKDSVTISVDGVVYYRVQNATLAVANITNADSATRLLAQTTLRNVLGTKNLSQILSDREEIAHNMQSTLDDATDAWGIKVERVEIKDVKLPVQLQRAMAAEAEASREARAKVIAAEGEMNASRALKEASMVITESPAALQLRYLQTLTTIAAEKNSTIVFPLPIDMLQGIIGAKHSHLG

SEQ ID NO: 339 - DNA, 3878 bp, Homo sapiens
  unsure 1996: unknown base
tctagagccctctcccaacatggcggcctcagcaaaaaagaagaataagaaggggaagactatctccctaacagactttctggctgaggatgggggtactggtggaggaagcacctatgtttccaaaccagtcagctgggctgatgaaacggatgacctggaaggagatgtttcgaccacttggcacagtaacgatgacgatgtgtatagggcgcctccaattgaccgttccatccttcccactgctccacgggctgctcgggaacccaatatcgaccggagccgtcttcccaaatcgccaccctacactgcttttctaggaaacctaccctatgatgttacagaagagtcaattaaggaattctttcgaggattaaatatcagtgcagtgcgtttaccacgtgaacccagcaatccagagaggttgaaaggttttggttatgctgaatttgaggacctggattccctgctcagtgccctgagtctcaatgaagagtctctaggtaacaggagaattcgagtggacgttgctgatcaagcacaggataaagacagggatgatcgttcttttggccgtgatagaaatcgggattctgacaaaacagatacagactggagggctcgtcctgctacagacagctttgatgactacccacctagaagaggtgatgatagctttggagacaagtatcgagatcgttatgattcagaccggtatcgggatgggtatcgggatgggtatcgggatggcccacgccgggatatggatcgatatggtggccgggatcgctatgatgaccgaggcagcagagactatgatagaggctatgattcccggataggcagtggcagaagagcatttggcagtgggtatcgcagggatgatgactacagaggaggcggggaccgctatgaagaccgatatgacagacgggatgatcggtcgtggagctccagagatgattactctcgggatgattataggcgtgatgatagaggtcccccccaaagacccaaactgaatctaaagcctcggagtactcctgaagaagatgattcctctgctagtacctcccagtccactcgagctgcttctatctttggaggggcaaagcctgttgacacagctgctagagaaagagaagtagaagaacggctacagaaggaacaagagaagttgcagcgtcagtggaatgagccaaaactagaacgacggcctcgggagagacacccaagctggcgaagtgaagaaactcaggaacgggaacggtcgaggacaggaagtgagtcatcacaaactgggacctccaccacatctagcagaaatgcacgaaggagagagagtgagaagtctctagaaaatgaaacactcaataaggaggaagattgccactctccaacttctaaacctcccaaacctgatcagcccctaaaggtaatgccagcccctccaccaaaggagaatgcttgggtgaagcgaagttctaaccctcctgctcgatctcagagctcagacacagagcagcagtcccctacaagtggtgggggaaaagtagctccagctcaaccatctgaggaaggaccaggaaggaaagatgaaaataaagtagatgggatgaatgccccaaaaggccaaactgggaactctagccgtggtccaggagacggagggaacagagaccactggaaggagtcagataggaaagatggcaaaaaggatcaagactccagatctgcacctgagccaaagaaacctgaggaaaatccagcttctaagttcagttctgcaagcaagtatgctgctctctctgttgatggtgaagatgaaaatgagggagaagattatgccgaatagacctctacatcctgtgcttttctcctagtttctctccaccctggaacattcgagagcaaatcaaaacctctatccagacaagacaaaataaaactcaacatctcctgaagacctttcttacctttttttaaaaacaaaaantgaaattattttgcatgctgctgcagcctttaaagtattgaagtaactggagaattgccaatacagccagagagaaagggactacagctttttagaggaaaagttgtggtgcgttatgtcaccatgcagttgccagtgtgattagtgcctaggggtctcatttagcagaaatggtaatgacagtgatataatgcctggaacctggttgggcagtaggggagggaggtagaaggaaaagtgtgagatttctaccttttagttttcatcctattgtggcatatatgaattctcaaacattatctgaataaattttccactcttggaaaggtagatttagcctcaagttgttctagtctccaggaggctgccagcccctcctcttatttaattctgagttttgggggccagcctagagggaattcctttttttttttttttaaccccccaggggggtagttgggagtgagactataggccataaagaatgggactgcattggaccaaaataaatgggaaaatcgtggtttgaaaagaagcttttgggaagtgatgagtcattttgcaccaggtaataggggaaaattgtgtgacctccagcaaacacatgaatggttatttcctggagccggaagcacttgggggtcgtggtaattcccagtgttttctgtgtcctagttttaccctttctaaacactgtcctttttgaaagttttgaatatatccacattctattgaaaccttgaaactaaaaatttagactcttatcgtcatcttaagttcttcatgctactcttaacctcccaaaaagcagtatctaagtcacatacatgatgtcttgggcattttctgagccatggagaactctgaaaggaagaatcgctgcttttctcaagcaaatcggtttcttgatgtcttttggttctccttgcctgctcctgatgcttggaccccttttattgatcagagtgctctagaataatggatggtcttggatgatggataaatagggacagggacagttaaattgggagcctttcttacaaccttgatgggatttttccccccaagtttccttctccactgaaatgccacactaatgcttgttggattcatgaggtggccagaccaatgtgttgttttgttgttgttttttttttaagcttcccttgagagaataaatggtaatggagagaatcatttaacaaggtcctggtttctcttgcaacacagtagctaaacttgcctgcttttatatgcatttttgtagggatcagcttggtagacagtattagcggagaaacaccttgatcttggtttgcaagcccttctcccatcagtcctagattaggccctgttcagccatgcaggggtgttggtttatgcgtgctgcagcagtgggcataatgaatataatttacccagtggacaaaggtgtgtaccaagtgaatttaaataattggtgtggattggccagtagctaagaagtgggcttttaaagagtattgaagattgaaagggtttttctttcttttttaaaaaagaaaaacaaactattgattgtagataatgaaaagctagggtttgccctcttcatgtctactctccttccaaatagttatatccaaaactgtttttccctctcccctaccttgtcccccctattaaaatagaaacagggattgattaatgtcccgctcctgaatacatgtaaaatttgtacaaaaatatcttctatgaaaatgatttgtaatctgtagacttattacctgggagatgtcttgatgtaaaatcccatcctttgggttgtgggttttttgttttctccaaataaatctgatctttaaagttaaaaaaaaaaaaaaactctagagtcgaggaattc

SEQ ID NO: 340 - protein, 611 aa, Homo sapiens
MAASAKKKNKKGKTISLTDFLAEDGGTGGGSTYVSKPVSWADETDDLEGDVSTTWHSNDDDVYRAPPIDRSILPTAPRAAREPNIDRSRLPKSPPYTAFLGNLPYDVTEESIKEFFRGLNISAVRLPREPSNPERLKGFGYAEFEDLDSLLSALSLNEESLGNRRIRVDVADQAQDKDRDDRSFGRDRNRDSDKTDTDWRARPATDSFDDYPPRRGDDSFGDKYRDRYDSDRYRDGYRDGYRDGPRRDMDRYGGRDRYDDRGSRDYDRGYDSRIGSGRRAFGSGYRRDDDYRGGGDRYEDRYDRRDDRSWSSRDDYSRDDYRRDDRGPPQRPKLNLKPRSTPEEDDSSASTSQSTRAASIFGGAKPVDTAAREREVEERLQKEQEKLQRQWNEPKLERRPRERHPSWRSEETQERERSRTGSESSQTGTSTTSSRNARRRESEKSLENETLNKEEDCHSPTSKPPKPDQPLKVMPAPPPKENAWVKRSSNPPARSQSSDTEQQSPTSGGGKVAPAQPSEEGPGRKDENKVDGMNAPKGQTGNSSRGPGDGGNRDHWKESDRKDGKKDQDSRSAPEPKKPEENPASKFSSASKYAALSVDGEDENEGEDYAE

SEQ ID NO: 341 - DNA, 997 bp, Homo sapiens
gcgtggacaccacctcagcccactgagcaggagtcacagcacgaagaccaagcgcaaagcgacccctgccctccatcctgactgctcctcctaagagagatggcaccggccagagcaggattctgcccccttctgctgcttctgctgctggggctgtgggtggcagagatcccagtcagtgccaagcccaagggcatgacctcatcacagtggtttaaaattcagcacatgcagcccagccctcaagcatgcaactcagccatgaaaaacattaacaagcacacaaaacggtgcaaagacctcaacaccttcctgcacgagcctttctccagtgtggccgccacctgccagacccccaaaatagcctgcaagaatggcgataaaaactgccaccagagccacgggcccgtgtccctgaccatgtgtaagctcacctcagggaagtatccgaactgcaggtacaaagagaagcgacagaacaagtcttacgtagtggcctgtaagcctccccagaaaaaggactctcagcaattccacctggttcctgtacacttggacagagtcctttaggtttccagactggcttgctctttggctgaccttcaattccctctccaggactccgcaccactcccctacacccagagcattctcttcccctcatctcttggggctgttcctggttcagcctctgctgggaggctgaagctgacactctggtgagctgagctctagagggatggcttttcatctttttgttgctgttttcccagatgcttatccccaagaaacagcaagctcaggtctgtgggttccctggtctatgccattgcacatgtctcccctgccccctggcattagggcagcatgacaaggagaggaaataaatggaaagggggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 342 - protein, 156 aa, Homo sapiens
MAPARAGFCPLLLLLLLGLWVAEIPVSAKPKGMTSSQWFKIQHMQPSPQACNSAMKNINKHTKRCKDLNTFLHEPFSSVAATCQTPKIACKNGDKNCHQSHGPVSLTMCKLTSGKYPNCRYKEKRQNKSYVVACKPPQKKDSQQFHLVPVHLDRVL

SEQ ID NO: 343 - DNA, 2265 bp, Homo sapiens
gcatttgccactggttgcagatcaggcggacgaggagccgggaaggcagagccatgtggctgccccctgctctgctccttctcagcctctcaggctgtttctccatccaaggcccagagtctgtgagagccccagagcaggggtccctgacggttcaatgccactataagcaaggatgggagacctacattaagtggtggtgccgaggggtgcgctgggatacatgcaagatcctcattgaaaccagagggtcggagcaaggagagaagagtgaccgtgtgtccatcaaggacaatcagaaagaccgcacgttcactgtgaccatggaggggctcaggcgagatgacgcagatgtttactggtgtgggattgaaagaagaggacctgaccttgggactcaagtgaaagtgatcgttgacccagagggagcggcttccacaacagcaagctcacctaccaacagcaatatggcagtgttcatcggctcccacaagaggaaccactacatgctcctggtatttgtgaaggtgcccatcttgctcatcttggtcactgccatcctctggttgaaggggtctcagagggtccctgaggagccaggggaacagcctatctacatgaacttctccgaacctctgactaaagacatggccacttagagagatggatctgcagagccttcctgccctggccacgtttccagaagagactcgggctgtggaaggaacatctacgagtcctcgggatgcagtgactgagataggggccctgggcctccgccctggccttggagctggtgggcacctccctgttctgcacagctcagggacttagccaggtcctctcctgagccaccatcacctcctggggtgccagcacctgttctcttggtcaggagctgtagagatggagctcaagcactggacgactctgtccccactgctggaataactcgggcacagagcatgggaccaaagtacagaaagaggttgggggagacccccccagccctagacttccatcattccggagaccaactcaacaccgtctttgcctgagaacctgatatatccgtgtttttaaatttttttttttctagcaaagttgggttttaatgacttatgttcataggaaacctctctgatcccacacacaaggagggtgattctgggatgagttcctggttctagggcatgaggggctggatggaccctgtccccagggaggacatggctctgagtccacagggctgaggaggcaatgggaacctccctggcccggcccggtgcttgtcctccccctcccacctcttcctcctcctagctccccaagctccctgcctattcccccacctccgaggggctgcagcttgggagcctcctcagcatgacagcttgggtctcctccccaaaagagcctgtcaggcctcaagaaccacctccaggtggggagggcagtaacgaaaaccatcgcaggaaatggcaccctcccttttcggtgatgttgaaatcatgttactaatgaaaactgtcctagggaagtggttctgtctcctcacaggcttcacccacggcgatgaggcccttgaatgtggtcactttgtgctgtatggttgagggaccctcacaccaaagggaccttcccatgtgagatgtgctcccgcccccacctgcccacaagcaaacacaccacacatgttcggcatgttgccctttgaacacccatgaggacgcctccaacctgctcttggttctaatagggagtactgactgtcagcagtggataaaggagaggggaccctctggtccctagcatggcacccagagcctcccctcttcttgtccttcagccaaagagaaactttctctgactttgaactgaatttaggtctctggccaatgatgggcctgaaaattccataatggccagagaggagagttcgagcccggctaagatcccctgagtcattctgtgagggaccaagacccacagtccaccagccccagggccctacctcctggaatgctttcctggatccagcttcccgaagatccgaccagacccagggaggacggcaccgctccgcgggagggaaagccaaagcatggtgcttcaccagctggactcaggggcgaggggacatgggcgcttgtcaacgtgatgtcattcttttcccaccgtttcttcctgttgatattcaatgaatccgtcaatctctctgggaaaaaaaaaaaaaaaaaaaaaaaaaaaaaaaaaaaaaaaaaa

SEQ ID NO: 344 - protein, 201 aa, Homo sapiens
MWLPPALLLLSLSGCFSIQGPESVRAPEQGSLTVQCHYKQGWETYIKWWCRGVRWDTCKILIETRGSEQGEKSDRVSIKDNQKDRTFTVTMEGLRRDDADVYWCGIERRGPDLGTQVKVIVDPEGAASTTASSPTNSNMAVFIGSHKRNHYMLLVFVKVPILLILVTAILWLKGSQRVPEEPGEQPIYMNFSEPLTKDMAT

SEQ ID NO: 345 - DNA, 3501 bp, Homo sapiens
ctgagctcccgggctccggcagcgcgctggcggggcgccgcattgcacactctgggggcgccgcagtgttcgtgggatggggcagcgggctgcagctggcggccggaatccgcgcgcagcccgggtgcaagttctctcctgttgccctgagtgcccactcccaggccctctgtatgagtgacacttcagtctgccatggaacctggccctgctctggcctggctcctgctcctgagcctgctggcggattgtctgaaagctgctcagtcccgagacttcacagtgaaagacattatctacctccatccttcaaccacaccatatcctggtggatttaaatgtttcacctgtgaaaaggcagcagacaattatgagtgcaaccgatgggctccagacatctactgccctcgagagaccagatactgctacactcagcacacaatggaagtcacaggaaacagtatctcagtcaccaaacgctgtgtcccactggaagagtgcttatccactggctgcagagactccgagcatgaaggccacaaggtctgcacttcttgttgtgaaggaaatatctgtaacttgccactgccccgaaatgaaactgatgccacatttgccacgacgtcacctataaatcagacaaatgggcacccacgctgtatgtcagtgatagtgtcctgcttgtggttgtggttagggctcatgttatagtggctcagtggctccatgtgttaatagcgatccatggggatctcgatggtccacagacctgcatgagtcattggcctgacagtaattacacatgtgagacacaacactcttggaggtcatcacagccaagcattgccacttaccatgaggaataaatgttgcttcattgtagccattttgagtctaaccgagactcatcaaagccttctgtcagtacagcccaagttccataccataaacgtttgttttcattccaagaagtagttctgcatttatcgagatctggggttcttaatttggaagaatacatgcatgagatgcagtaggtcctgagactgtaagatattaggagtatgttataggggcatgtatagatgtgggcttttcaggagaaaagtaaccattggtttaaatataatcatgagttcatttgtagctttagaattttaaaacattgactccaaactgaatggactatttccttggaaattctgactgagtccctggaagagtagtaattccaacaattccagccatttgttcaattaattttcccaacattcttctcccagtgctgggaatcacatttcctctgttctgtgcagaagacaaaaaggcaatcataaaagtttgttatatttgtgggggtgcctggaggaggattttcctcaacttaatggagccactgtccataaagtggctgttatcccttcatataattggtgagatcagccttctccttgacttggcacctaattatgcttcatgagatcctagattccacctgagtcaattgtgtccagagccccaaaccaggatggagttgttttccccagatatggggttctattcagccatagataatctagacagaggatttcagaatgaaaggaaaaatgtgtggagattagtcctagttcattctgagggccgactaagtggctcagccagcttcttactccatctgcagttcatactgccaaagagctcccacttccaaatccccagtgactttatggagaagattctgcattaaattgtctttcgaatgatggggaagcaaggcataatatgcgatgatgaggagaaagtagaccagtgaggtgattgcaagactaacaaggagactcaatgggaagtttttctttcttttagatattgcttttgaagtagatggtaaaatttttgtcatccttcttgtattttttgtaccccaagttacaatttttcttcttccttgtaaataatttaaacagtatttatttttgtaaggcataactagaaactaaaatatattctaaaaaattcattattctgaacaaagtgatcaaattagaatacatatttttcaacagtggtagagcttttaatatatgtttattgaaagttatctataatacttgcaccagtgttgaaaaaagttaacatgtaggcaagagcaatatgtttgtctcaaggatttttccatggtttcctcagtgatggtgtcctggaattattcaggtggtgaccatcactggtctaagtttgtgtgcagggttttcagacgtgtttttgtgaaacttggtagaaccatggctaataaagaggacagtgttgtcagggtccatctgccctccatagaaaaatgtctctggctcataaaatgagactccctcagggactaaatatgaactgacagcagtaactctgatacagaataatctaaattgcatcaaatggccttaattcagagtttgttaggcttatcagtatgttgcttttaattggggtgggaaagtagagggagagaaagcaagacatttattaagcacctcgtatgtgccaggcactatgctaagcactttacataagttaggattaatccctgcaagaatcctataaagaatgttactagcatttacacttcccaaatgaaggtaccaaagctcaaacgcaatgttgtgaagctgtttccttcagatttaggttatgtgggatgatgtgggattgaagaggaaagaaaggtgggattatccccctaggaagactttcaggcctgacttcataggaattcatccatcttatcatgtggagtttatctcaccctgctgttgcaggatgctatttgcatgtgtccccaggtgatgttttttctttggggagtaggggtttggcttcctcattcatccctcttgctaaaagaggagatagttgatgttgcatctaaagatgctataagacaatgaaagtttgatgttgtacatacctacaagtaccatttttgtgcatgattacactccactgacatcttccaagtactacatgtgattgaataagaaacaagaaagtgaccacaccaaagcctccctggctggtgtacagggatcaggtccacagtggtgcagattcaaccaccacccagggagtgcttgcagactctgcatagatgttgctgcatgcgtcccatgtgcctgtcagaatggcagtgtttaattctcttgaaagaaagttatttgctcactatccccagcctcaaggagccaaggaagagtcattcacatggaaggtccgggactggtcagccactctgacttttctaccacattaaattctccattacatctcactattggtaatggcttaagtgtaaagagccatgatgtgtatattaagctatgtgccacatatttatttttagactctccacagcattcatgtcaatatgggattaatgcctaaactttgtaaatattgtacagtttgtaaatcaatgaataaaggttttgagtgtaaaaaaaaaaaaaaaaa

SEQ ID NO: 346 - protein, 171 aa, Homo sapiens
MEPGPALAWLLLLSLLADCLKAAQSRDFTVKDIIYLHPSTTPYPGGFKCFTCEKAADNYECNRWAPDIYCPRETRYCYTQHTMEVTGNSISVTKRCVPLEECLSTGCRDSEHEGHKVCTSCCEGNICNLPLPRNETDATFATTSPINQTNGHPRCMSVIVSCLWLWLGLML

SEQ ID NO: 347 - DNA, 2016 bp, Homo sapiens
gatcaagcgccttcctttcccttcctctccctacttggcctttgccctaagccaagacctggccatcagcctggctgcaggggcctgcagagccagctgcactttttcaggtatgggggagggccaggcaccatgaagccagtgtgggtcgccacccttctgtggatgctactgctggtgcccaggctgggggccgcccggaaggggtccccagaagaggcctccttctactatggaaccttccctcttggcttctcctggggcgtgggcagttctgcctaccagacggagggcgcctgggaccaggacgggaaagggcctagcatctgggacgtcttcacacacagtgggaaggggaaagtgcttgggaatgagacggcagatgtagcctgtgacggctactacaaggtccaggaggacatcattctgctgagggaactgcacgtcaaccactaccgattctccctgtcttggccccggctcctgcccacaggcatccgagccgagcaggtgaacaagaagggaatcgaattctacagtgatcttatcgatgcccttctgagcagcaacatcactcccatcgtgaccttgcaccactgggatctgccacagctgctccaggtcaaatacggtgggtggcagaatgtgagcatggccaactacttcagagactacgccaacctgtgctttgaggcctttggggaccgtgtgaagcactggatcacgttcagtgatcctcgggcaatggcagaaaaaggctatgagacgggccaccatgcgccgggcctgaagctccgcggcaccggcctgtacaaggcagcacaccacatcattaaggcccacgccaaaacctggcattcttataacaccacgtggcgcagcaagcagcaaggtctggtgggaatttcactgaactgtgactggggggaacctgtggacattagtaaccccaaggacctagaggctgccgagagatacctacagttctgtctgggctggtttgccaaccccatttatgccggtgactacccccaagtcatgaaggactacattggaagaaagagtgcagagcaaggcctggagatgtcgaggttaccggtgttctcactccaggagaagagctacattaaaggcacatccgatttcttgggattaggtcattttactactcggtacatcacggaaaggaactacccctcccgccaggggcccagctaccagaacgatcgtgacttgatagagctggttgacccaaactggccagatctggggtctaaatggctatattctgtgccatggggatttaggaggctccttaactttgctcagactcaatacggtgatcctcccatatatgtgatggaaaatggagcatctcaaaaattccactgtactcaattatgtgatgagtggagaattcaataccttaaaggatacataaatgaaatgctaaaagctataaaagatggtgctaatataaaggggtatacttcctggtctctgttggataagtttgaatgggagaaaggatactcagatagatatggattctactatgttgaatttaacgacagaaataagcctcgctatccaaaggcttcagttcaatattacaagaagattatcattgccaatgggtttcccaatccaagagaggtggaaagttggtacctcaaagctttggaaacttgctctatcaacaatcagatgcttgctgcagagcctttgctaagtcacatgcaaatggttacggagatcgtggtacccactgtctgctccctctgtgtcctcatcactgctgttctactaatgctcctcctgaggaggcagagctgagacaggattatcaattttggagcttcataagagaatcttcaggatcttcctcccttttctgctttgagggtttccatacattgctgttttcaggttctacaataattacctttttttctctttctctttttggcttgtgctgggatttaagaattagaaaataaaaataagcagaaatta

SEQ ID NO: 348 - protein, 567 aa, Homo sapiens
MKPVWVATLLWMLLLVPRLGAARKGSPEEASFYYGTFPLGFSWGVGSSAYQTEGAWDQDGKGPSIWDVFTHSGKGKVLGNETADVACDGYYKVQEDIILLRELHVNHYRFSLSWPRLLPTGIRAEQVNKKGIEFYSDLIDALLSSNITPIVTLHHWDLPQLLQVKYGGWQNVSMANYFRDYANLCFEAFGDRVKHWITFSDPRAMAEKGYETGHHAPGLKLRGTGLYKAAHHIIKAHAKTWHSYNTTWRSKQQGLVGISLNCDWGEPVDISNPKDLEAAERYLQFCLGWFANPIYAGDYPQVMKDYIGRKSAEQGLEMSRLPVFSLQEKSYIKGTSDFLGLGHFTTRYITERNYPSRQGPSYQNDRDLIELVDPNWPDLGSKWLYSVPWGFRRLLNFAQTQYGDPPIYVMENGASQKFHCTQLCDEWRIQYLKGYINEMLKAIKDGANIKGYTSWSLLDKFEWEKGYSDRYGFYYVEFNDRNKPRYPKASVQYYKKIIIANGFPNPREVESWYLKALETCSINNQMLAAEPLLSHMQMVTEIVVPTVCSLCVLITAVLLMLLLRRQS

SEQ ID NO: 349 - DNA, 1402 bp, Homo sapiens
cgcaaagccgccctcggggcgctcatggcgggacgcctcctgggaaaggctttagccgcggtgtctctctctctggccttggcctctgtgactatcaggtcctcgcgctgccgcggcatccaggcgttcagaaactcgttttcatcttcttggtttcatcttaataccaacgtcatgtctggttctaatggttccaaagaaaattctcacaataaggctcggacgtctccttacccaggttcaaaagttgaacgaagccaggttcctaatgagaaagtgggctggcttgttgagtggcaagactataagcctgtggaatacactgcagtctctgtcttggctggacccaggtgggcagatcctcagatcagtgaaagtaatttttctcccaagtttaacgaaaaggatgggcatgttgagagaaagagcaagaatggcctgtatgagattgaaaatggaagaccgagaaatcctgcaggacggactggactggtgggccgggggcttttggggcgatggggcccaaatcacgctgcagatcccattataaccagatggaaaagggatagcagtggaaataaaatcatgcatcctgtttctgggaagcatatcttacaatttgttgcaataaaaaggaaagactgtggagaatgggcaatcccaggggggatggtggatccaggagagaagattagtgccacactgaaaagagaatttggtgaggaagctctcaactccttacagaaaaccagtgctgagaagagagaaatagaggaaaagttgcacaaactcttcagccaagaccacctagtgatatataagggatatgttgatgatcctcgaaacactgataatgcatggatggagacagaagctgtgaactaccatgacgaaacaggtgagataatggataatcttatgctagaagctggagatgatgctggaaaagtgaaatgggtggacatcaatgataaactgaagctttatgccagtcactctcaattcatcaaacttgtggctgagaaacgagatgcacactggagcgaggactctgaagctgactgccatgcgttgtagctgatggtctccgtgtaagccaaaggcccacagaggagcatatactgaaaagaaggcagtatcacagaatttatactataaaaagggcagggtaggccacttggcctatttactttcaaaacaatttgcatttagagtgtttcgcatcagaataacatgagtaagatgaactggaacacaaaattttcagctctttggtcaaaaggaatataagtaatcatattttgtatgtattcgatttaagcatggcttaaattaaatttaaacaactaatgctctttgaagaatcataatcagaataaagataaattcttgatcagctata

SEQ ID NO: 350 - protein, 350 aa, Homo sapiens
MAGRLLGKALAAVSLSLALASVTIRSSRCRGIQAFRNSFSSSWFHLNTNVMSGSNGSKENSHNKARTSPYPGSKVERSQVPNEKVGWLVEWQDYKPVEYTAVSVLAGPRWADPQISESNFSPKFNEKDGHVERKSKNGLYEIENGRPRNPAGRTGLVGRGLLGRWGPNHAADPIITRWKRDSSGNKIMHPVSGKHILQFVAIKRKDCGEWAIPGGMVDPGEKISATLKREFGEEALNSLQKTSAEKREIEEKLHKLFSQDHLVIYKGYVDDPRNTDNAWMETEAVNYHDETGEIMDNLMLEAGDDAGKVKWVDINDKLKLYASHSQFIKLVAEKRDAHWSEDSEADCHAL

SEQ ID NO: 351 - DNA, 1863 bp, Homo sapiens
cctctgtctgtgctcccatcccagggagtataggtggagcctccagagcccatggacagggcatgctggggctgggccagccccagcggtgtctctaaggcacccctgggatccccactgagctggcctacttcagacagccagggcccacccctctggcccccttagtgtccagctcgtggccccttggcatttccacaagacgccaagatggagattcccatggggacccagggctgcttctcaaagagcctcctgctctcagcctcaatcctggtcctctggatgctccaaggctcccaggcagctctctacatccagaagattccagagcagcctcaaaagaaccaggaccttctcctgtcagtccagggtgtcccagacaccttccaggacttcaactggtacctgggggaggagacgtacggaggcacgaggctatttacctacatccctgggatacaacggcctcagagggatggcagtgccatgggacagcgagacatcgtgggcttccccaatggttccatgctgctgcgccgcgcccagcctacagacagtggcacctaccaagtagccattaccatcaactctgaatggactatgaaggccaagactgaggtccaggtagctgaaaagaataaggagctgcccagtacacacctgcccaccaacgctgggatcctggcggccaccatcattggatctcttgctgccggggcccttctcatcagctgcattgcctatctcctggtgacaaggaactggaggggccagagccacagactgcctgctccgaggggccagggatctctgtccatcttgtgctcggctgtatccccagtgccttcagtgacgcccagcacatggatggcgaccacagagaagccagaattgggccctgctcatgatgctggtgacaacaacatctatgaagtgatgccctctccagtcctcctggtgtcccccatcagtgacacaaggtccataaacccagcccggcccctgcccacacccccacacctgcaggcggagccagagaaccaccagtaccagcaggacctgctaaaccccgaccctgccccctactgccagctggtgccaacttcctgatgggtcctgggccaggccagccagggagaagacaaggccccagccctcctctgggagcctcacacctgagaccagcaggacaaggccattgggggctgtggggccgatgaggtggactcagccaaagactcagcagcacatggggcaggtgtcctggcagggggacaggagactgtaacaggcccaggtccttgtgcagcccctgaatgcacgcccgccttcggtctgttccttcaagcaagctggcctgggccatgtgcctgtgaaaggcaggctctggcccctttccatgccaaagtcccccaagatctggatatctggggacaagatggtggcctcaggcctgcctcccaggcagttggctgggctcccaactgtctgtcctcaatgccctaccccaactccactagtgaccctcagagtcttctccccttaggacaaggcagacaccccaccatgcgggcctcaggtggcagagaggcccagcctcacaggcctgtggccccacacaccagtcccagcaaggtgaccacggctgctggaccccttccctgttcaggcaggcccagcccctctcagaacctgctgccagctgctggtcttggcccccaccctgaatcttactgagtccctctgggcagcagctcccttctccaccccaccccagcacccgtcccaaatgtggcctcagcttgtcctccccttccccaaactatgcattcattcagcaataaatgagcctttgctgca

SEQ ID NO: 352 - protein, 300 aa, Homo sapiens
MEIPMGTQGCFSKSLLLSASILVLWMLQGSQAALYIQKIPEQPQKNQDLLLSVQGVPDTFQDFNWYLGEETYGGTRLFTYIPGIQRPQRDGSAMGQRDIVGFPNGSMLLRRAQPTDSGTYQVAITINSEWTMKAKTEVQVAEKNKELPSTHLPTNAGILAATIIGSLAAGALLISCIAYLLVTRNWRGQSHRLPAPRGQGSLSILCSAVSPVPSVTPSTWMATTEKPELGPAHDAGDNNIYEVMPSPVLLVSPISDTRSINPARPLPTPPHLQAEPENHQYQQDLLNPDPAPYCQLVPTS

SEQ ID NO: 353 - DNA, 1152 bp, Homo sapiens
cttcagaacaggttctccttccccagtcaccagttgctcgagttagaattgtctgcaatggccgccctgcagaaatctgtgagctctttccttatggggaccctggccaccagctgcctccttctcttggccctcttggtacagggaggagcagctgcgcccatcagctcccactgcaggcttgacaagtccaacttccagcagccctatatcaccaaccgcaccttcatgctggctaaggaggctagcttggctgataacaacacagacgttcgtctcattggggagaaactgttccacggagtcagtatgagtgagcgctgctatctgatgaagcaggtgctgaacttcacccttgaagaagtgctgttccctcaatctgataggttccagccttatatgcaggaggtggtgcccttcctggccaggctcagcaacaggctaagcacatgtcatattgaaggtgatgacctgcatatccagaggaatgtgcaaaagctgaaggacacagtgaaaaagcttggagagagtggagagatcaaagcaattggagaactggatttgctgtttatgtctctgagaaatgcctgcatttgaccagagcaaagctgaaaaatgaataactaaccccctttccctgctagaaataacaattagatgccccaaagcgattttttttaaccaaaaggaagatgggaagccaaactccatcatgatgggtggattccaaatgaacccctgcgttagttacaaaggaaaccaatgccacttttgtttataagaccagaaggtagactttctaagcatagatatttattgataacatttcattgtaactggtgttctatacacagaaaacaatttattttttaaataattgtctttttccataaaaaagattactttccattcctttaggggaaaaaacccctaaatagcttcatgtttccataatcagtactttatatttataaatgtatttattattattataagactgcattttatttatatcattttattaatatggatttatttatagaaacatcattcgatattgctacttgagtgtaaggctaatattgatatttatgacaataattatagagctataacatgtttatttgacctcaataaacacttggatatccc

SEQ ID NO: 354 - protein, 179 aa, Homo sapiens
MAALQKSVSSFLMGTLATSCLLLLALLVQGGAAAPISSHCRLDKSNFQQPYITNRTFMLAKEASLADNNTDVRLIGEKLFHGVSMSERCYLMKQVLNFTLEEVLFPQSDRFQPYMQEVVPFLARLSNRLSTCHIEGDDLHIQRNVQKLKDTVKKLGESGEIKAIGELDLLFMSLRNACI

SEQ ID NO: 355 - DNA, 1060 bp, Homo sapiens
tggcctactggaaaaaaaaaaaaaaaaaaaaaaagtcacccgggcccgcggtggccacaacatggctgcggcgccggggctgctcttctggctgttcgtgctgggggcgctctggtgggtcccgggccagtcggatctcagccacggacggcgtttctcggacctcaaagtgtgcggggacgaagagtgcagcatgttaatgtaccgtgggaaagctcttgaagacttcacgggccctgattgtcgttttgtgaattttaaaaaaggtgacgatgtatatgtctactacaaactggcagggggatcccttgaactttgggctggaagtgttgaacacagttttggatattttccaaaagatttgatcaaggtacttcataaatacacggaagaagagctacatattccagcagatgagacagactttgtctgctttgaaggaggaagagatgattttaatagttataatgtagaagagcttttaggatctttggaactggaggactctgtacctgaagagtcgaagaaagctgaagaagtttctcagcacagagagaaatctcctgaggagtctcgggggcgtgaacttgaccctgtgcctgagcccgaggcattcagagctgattcagaggatggagaaggtgctttctcagagagcaccgaggggctgcagggacagccctcagctcaggagagccaccctcacaccagcggtcctgcggctaacgctcagggagtgcagtcttcgttggacacttttgaagaaattctgcacgataaattgaaagtgccgggaagcgaaagcagaactggcaatagttctcctgcctcggtggagcgggagaagacagatgcttacaaagtcctgaaaacagaaatgagtcagagaggaagtggacagtgcgttattcattacagcaaaggatttcgttggcatcaaaatctaagtttgttttacaaagattgtttttagtactaagctgccttggcagtttgcatttttgagccaaacaaaaatatattattttcccttctaagtaaaaaaaaaaaaaaaaaaaaa

SEQ ID NO: 356 - protein, 303 aa, Homo sapiens
MAAAPGLLFWLFVLGALWWVPGQSDLSHGRRFSDLKVCGDEECSMLMYRGKALEDFTGPDCRFVNFKKGDDVYVYYKLAGGSLELWAGSVEHSFGYFPKDLIKVLHKYTEEELHIPADETDFVCFEGGRDDFNSYNVEELLGSLELEDSVPEESKKAEEVSQHREKSPEESRGRELDPVPEPEAFRADSEDGEGAFSESTEGLQGQPSAQESHPHTSGPAANAQGVQSSLDTFEEILHDKLKVPGSESRTGNSSPASVEREKTDAYKVLKTEMSQRGSGQCVIHYSKGFRWHQNLSLFYKDCF

SEQ ID NO: 357 - DNA, 1517 bp, Homo sapiens
acgcgcccggcagctgtccaccgatcccggccaccgcccccggccacccccaccccgcgagcccatggaggctccgggaccccgcgccttgcggactgcgctctgtggcggctgttgctgcctcctcctatgtgcccagctggctgtggctggtaaaggagctcgaggctttgggaggggagccctgatccgcctgaatatctggccggcggtccaaggggcctgcaaacagctggaggtctgtgagcactgcgtggagggagacagagcgcgcaatctctccagctgcatgtgggagcagtgccggccagaggagccaggacactgtgtggcccaatctgaggtggtcaaggaaggttgctccatctacaaccgctcagaggcatgtccagctgctcaccaccaccccacctatgaaccgaagacagtcacaacagggagccccccagtccctgaggcccacagccctggatttgacggggccagctttatcggaggtgtcgtgctggtgttgagcctacaggcggtggctttctttgtgctgcacttcctcaaggccaaggacagcacctaccagacgctgtgagtacctggccagcagcaagtacctgagtcccagctcacctcctggttcctgccccaccgttccccttcagtacccagggtgctgtcttctccatgggcaagccctcaggacggtgacagcgtgctccatgtgagccacaccccttttgtctcctccagttggggtgtttcctttgtcagatgttggctgggaccaggactcagcctgggccagtctaggagcccagctgagccctcctgtgtcttttcccttcatgctgccagcagggaagagaaccagtaggtgccagcccaggcaagcctgtggcccgcgtttctgtggctgtgggcaggagctgggccttgtgtctagttgggttttgctctgagaaggggagctgtgcctgaggccctctgtgtgccgtgtgtgctgtggggcgggtcgccacagcctgtgttaaagtgtttgctcttcctctgctgcctcctctcgaggcagggggtccttggctggctgaggcagtgtcaccttcctgagtgtcctctttggcctctgcagaatctgacccctttgggcctggactccatcctgaggggaaaggaggatgcagagggtggcctctgggcacccttgtgggtaagcggggggcgggggcgggaaaaactctggccgccagtttttggctcctgcgggcaccaagcaggctcagtgtctgatgcctgacatctcctcctgtcctgggcctggaacctgcagctgagaaaatccctcaaccacctcgtctcctccatcgcccctgctgggccccccagcctgacagtgggttgtatgcctgcctctttccaccaactggcctgggcactgcccccaaataaaggaactctgcactgcaaaaaaaaaaaaaaaaaaaaaaaaaaaaaaaaaaaaaaaaaaaaaaaaaaaaaaaaaacca

SEQ ID NO: 358 - protein, 173 aa, Homo sapiens
MEAPGPRALRTALCGGCCCLLLCAQLAVAGKGARGFGRGALIRLNIWPAVQGACKQLEVCEHCVEGDRARNLSSCMWEQCRPEEPGHCVAQSEVVKEGCSIYNRSEACPAAHHHPTYEPKTVTTGSPPVPEAHSPGFDGASFIGGVVLVLSLQAVAFFVLHFLKAKDSTYQTL

SEQ ID NO: 359 - DNA, 521 bp, Homo sapiens
ttccagtcagagttaagttaaaacagaaaaaaggaagatggcaagaatattgttacttttcctcccgggtcttgtggctgtatgtgctgtgcatggaatatttatggaccgtctagcttccaagaagctctgtgcagatgatgagtgtgtctatactatttctctggctagtgctcaagaagattataatgccccggactgtagattcattaacgttaaaaaagggcagcagatctatgtgtactcaaagctggtaaaagaaaatggagctggagaattttgggctggcagtgtttatggtgatggccaggacgagatgggagtcgtgggttatttccccaggaacttggtcaaggaacagcgtgtgtaccaggaagctaccaaggaagttcccaccacggatattgacttcttctgcgagtaataaattagttaaaactgcaaatagaaagaaaacaccaaaaataaagaaaagagcaaaagtggccaaaaaatgcatgtctgtaattttggactgacgt

SEQ ID NO: 360 - protein, 128 aa, Homo sapiens
MARILLLFLPGLVAVCAVHGIFMDRLASKKLCADDECVYTISLASAQEDYNAPDCRFINVKKGQQIYVYSKLVKENGAGEFWAGSVYGDGQDEMGVVGYFPRNLVKEQRVYQEATKEVPTTDIDFFCE

SEQ ID NO: 361 - DNA, 1070 bp, Murine
ggcacgagccaccacttacaaccacacagcctatccagaaacatgaagataagaaatgcttgtgctgtccttattgaagtactcctgtttatacttgaaggagttacaggagctcgaaaaatttcaactttctcaggccctggctcatggccgtgcaatcccaagtgtgatggcagaacttacaacccctcagaggagtgttgtgttcatgacaccatcctgccctttaagcggattaacctctgtggccctagctgcacctacaggccctgctttgagctctgctgtcctgagtcctatagccccaagaagaaatttattgtcaagcttaaagttcatggagagagatcccattgcagttcatcccctatctccaggaactgtaaaagcaacaagatttttcatggagaagatattgaagacaaccaactttctcttaggaaaaaaagtggtgaccagccttgagagtctgctttcttcctgcaagcaccagttcctgaatgttcttacttgaagaatggatacctgaagcattggggtgcagtgatatatgtgtctcattacaatgctcctttggatattgttttcctaagcatgtgttggaatgttcccccataactttctaaaattatcctatttcaatgcaactaaagataaatgtattccagccagagtccacagagaaggcaagttatgcaaggcaggcatggggccctcacaaaatttcaagctgtgcgacttatgtagtaattttctacaaacaatccctcctggatatccaggaggctccagacctgaataaaaaccacatgtctgtctagaaaaagggaatgaatcaagatccacaggaccttttcaagattttagaagcagcaaactatggctgagagaaaagactctctgaccaggcaaattgttctgcagtattctccgggcgtgtagctcccctgagtagtcgccaggctggtcttggctttgtaataatacagctgcctttgagtcctccctaccctgttagtaaccccttgcctgcactgttgtccttacaaccgaaataaactgattagttg

SEQ ID NO: 362 - protein, 140 aa, Murine
MKIRNACAVLIEVLLFILEGVTGARKISTFSGPGSWPCNPKCDGRTYNPSEECCVHDTILPFKRINLCGPSCTYRPCFELCCPESYSPKKKFIVKLKVHGERSHCSSSPISRNCKSNKIFHGEDIEDNQLSLRKKSGDQP

SEQ ID NO: 363 - DNA, 2380 bp, Homo sapiens
acactggccaaacaaaaacgaaagcactccgtgctggaagtaggaggagagtcaggactcccaggacagagagtgcacaaactacccagcacagccccctccgccccctctggaggctgaagagggattccagcccctgccacccacagacacgggctgactggggtgtctgccccccttgggggggggcagcacagggcctcaggcctgggtgccacctggcacctagaagatgcctgtgccctggttcttgctgtccttggcactgggccgaagcccagtggtcctttctctggagaggcttgtggggcctcaggacgctacccactgctctccgggcctctcctgccgcctctgggacagtgacatactctgcctgcctggggacatcgtgcctgctccgggccccgtgctggcgcctacgcacctgcagacagagctggtgctgaggtgccagaaggagaccgactgtgacctctgtctgcgtgtggctgtccacttggccgtgcatgggcactgggaagagcctgaagatgaggaaaagtttggaggagcagctgactcaggggtggaggagcctaggaatgcctctctccaggcccaagtcgtgctctccttccaggcctaccctactgcccgctgcgtcctgctggaggtgcaagtgcctgctgcccttgtgcagtttggtcagtctgtgggctctgtggtatatgactgcttcgaggctgccctagggagtgaggtacgaatctggtcctatactcagcccaggtacgagaaggaactcaaccacacacagcagctgcctgccctgccctggctcaacgtgtcagcagatggtgacaacgtgcatctggttctgaatgtctctgaggagcagcacttcggcctctccctgtactggaatcaggtccagggccccccaaaaccccggtggcacaaaaacctgactggaccgcagatcattaccttgaaccacacagacctggttccctgcctctgtattcaggtgtggcctctggaacctgactccgttaggacgaacatctgccccttcagggaggacccccgcgcacaccagaacctctggcaagccgcccgactgcgactgctgaccctgcagagctggctgctggacgcaccgtgctcgctgcccgcagaagcggcactgtgctggcgggctccgggtggggacccctgccagccactggtcccaccgctttcctgggagaacgtcactgtggacaaggttctcgagttcccattgctgaaaggccaccctaacctctgtgttcaggtgaacagctcggagaagctgcagctgcaggagtgcttgtgggctgactccctggggcctctcaaagacgatgtgctactgttggagacacgaggcccccaggacaacagatccctctgtgccttggaacccagtggctgtacttcactacccagcaaagcctccacgagggcagctcgccttggagagtacttactacaagacctgcagtcaggccagtgtctgcagctatgggacgatgacttgggagcgctatgggcctgccccatggacaaatacatccacaagcgctgggccctcgtgtggctggcctgcctactctttgccgctgcgctttccctcatcctccttctcaaaaaggatcacgcgaaagggtggctgaggctcttgaaacaggacgtccgctcgggggcggccgccaggggccgcgcggctctgctcctctactcagccgatgactcgggtttcgagcgcctggtgggcgccctggcgtcggccctgtgccagctgccgctgcgcgtggccgtagacctgtggagccgtcgtgaactgagcgcgcaggggcccgtggcttggtttcacgcgcagcggcgccagaccctgcaggagggcggcgtggtggtcttgctcttctctcccggtgcggtggcgctgtgcagcgagtggctacaggatggggtgtccgggcccggggcgcacggcccgcacgacgccttccgcgcctcgctcagctgcgtgctgcccgacttcttgcagggccgggcgcccggcagctacgtgggggcctgcttcgacaggctgctccacccggacgccgtacccgcccttttccgcaccgtgcccgtcttcacactgccctcccaactgccagacttcctgggggccctgcagcagcctcgcgccccgcgttccgggcggctccaagagagagcggagcaagtgtcccgggcccttcagccagccctggatagctacttccatcccccggggactcccgcgccgggacgcggggtgggaccaggggcgggacctggggcgggggacgggacttaaataaaggcagacgctgtttttctaaaaaaa

SEQ ID NO: 364 - protein, 705 aa, Homo sapiens
MPVPWFLLSLALGRSPVVLSLERLVGPQDATHCSPGLSCRLWDSDILCLPGDIVPAPGPVLAPTHLQTELVLRCQKETDCDLCLRVAVHLAVHGHWEEPEDEEKFGGAADSGVEEPRNASLQAQVVLSFQAYPTARCVLLEVQVPAALVQFGQSVGSVVYDCFEAALGSEVRIWSYTQPRYEKELNHTQQLPALPWLNVSADGDNVHLVLNVSEEQHFGLSLYWNQVQGPPKPRWHKNLTGPQIITLNHTDLVPCLCIQVWPLEPDSVRTNICPFREDPRAHQNLWQAARLRLLTLQSWLLDAPCSLPAEAALCWRAPGGDPCQPLVPPLSWENVTVDKVLEFPLLKGHPNLCVQVNSSEKLQLQECLWADSLGPLKDDVLLLETRGPQDNRSLCALEPSGCTSLPSKASTRAARLGEYLLQDLQSGQCLQLWDDDLGALWACPMDKYIHKRWALVWLACLLFAAALSLILLLKKDHAKGWLRLLKQDVRSGAAARGRAALLLYSADDSGFERLVGALASALCQLPLRVAVDLWSRRELSAQGPVAWFHAQRRQTLQEGGVVVLLFSPGAVALCSEWLQDGVSGPGAHGPHDAFRASLSCVLPDFLQGRAPGSYVGACFDRLLHPDAVPALFRTVPVFTLPSQLPDFLGALQQPRAPRSGRLQERAEQVSRALQPALDSYFHPPGTPAPGRGVGPGAGPGAGDGT

SEQ ID NO: 365 - DNA, 1677 bp, Homo sapiens
aatagaagtcctcaggacggagcagaggtggccggcgggcccggctgactgcgcctctgctttctttccataaccttttctttcggactcgaatcacggctgctgcgaagggtctagttccggacactagggtgcccgaacgcgctgatgccccgagtgctcgcagggcttcccgctaaccatgctgccgccgccgcggcccgcagctgccttggcgctgcctgtgctcctgctactgctggtggtgctgacgccgcccccgaccggcgcaaggccatccccaggcccagattacctgcggcgcggctggatgcggctgctagcggagggcgagggctgcgctccctgccggccagaagagtgcgccgcgccgcggggctgcctggcgggcagggtgcgcgacgcgtgcggctgctgctgggaatgcgccaacctcgagggccagctctgcgacctggaccccagtgctcacttctacgggcactgcggcgagcagcttgagtgccggctggacacaggcggcgacctgagccgcggagaggtgccggaacctctgtgtgcctgtcgttcgcagagtccgctctgcgggtccgacggtcacacctactcccagatctgccgcctgcaggaggcggcccgcgctcggcccgatgccaacctcactgtggcacacccggggccctgcgaatcggggccccagatcgtgtcacatccatatgacacttggaatgtgacagggcaggatgtgatctttggctgtgaagtgtttgcctaccccatggcctccatcgagtggaggaaggatggcttggacatccagctgccaggggatgacccccacatctctgtgcagtttaggggtggaccccagaggtttgaggtgactggctggctgcagatccaggctgtgcgtcccagtgatgagggcacttaccgctgccttggccgcaatgccctgggtcaagtggaggcccctgctagcttgacagtgctcacacctgaccagctgaactctacaggcatcccccagctgcgatcactaaacctggttcctgaggaggaggctgagagtgaagagaatgacgattactactaggtccagagctctggcccatgggggtgggtgagcggctatagtgttcatccctgctcttgaaaagacctggaaaggggagcagggtcccttcatcgactgctttcatgctgtcagtagggatgatcatgggaggcctatttgactccaaggtagcagtgtggtaggatagagacaaaagctggaggagggtagggagagaagctgagaccaggaccggtggggtacaaaggggcccatgcaggagatgccctggccagtaggacctccaacaggttgtttcccaggctggggtgggggcctgagcagacacagaggtgcaggcaccaggattctccacttcttccagccctgctgggccacagttctaactgcccttcctcccaggccctggttcttgctatttcctggtccccaacgtttatctagcttgtttgccctttccccaaactcatcttccagaacttttccctctctcctaagccccagttgcacctactaactgcagtcccttttgctgtctgccgtcttttgtacaagagagagaacagcggagcatgacttagttcagtgcagagagattt

SEQ ID NO: 366 - protein, 304 aa, Homo sapiens
MLPPPRPAAALALPVLLLLLVVLTPPPTGARPSPGPDYLRRGWMRLLAEGEGCAPCRPEECAAPRGCLAGRVRDACGCCWECANLEGQLCDLDPSAHFYGHCGEQLECRLDTGGDLSRGEVPEPLCACRSQSPLCGSDGHTYSQICRLQEAARARPDANLTVAHPGPCESGPQIVSHPYDTWNVTGQDVIFGCEVFAYPMASIEWRKDGLDIQLPGDDPHISVQFRGGPQRFEVTGWLQIQAVRPSDEGTYRCLGRNALGQVEAPASLTVLTPDQLNSTGIPQLRSLNLVPEEEAESEENDDYY

SEQ ID NO: 367 - DNA, 697 bp, Homo sapiens
agacgctacaggatggagcggggcgcaggagccaagctgctgccgctgctgctgcttctgcgggcgactggtttcacatgtgcacagacagatggccggaacggctacacggcggtcatcgaagtgaccagcgggggtccctggggcgactgggcctggcctgagatgtgtcccgatggattcttcgccagcgggttctcgctcaaggtggagcctccccaaggcattcctggcgacgacactgcactgaatgggatcaggctgcactgcgcgcgcgggaacgtcctaggcaatacgcacgtggtagagtcccagtctggaagctggggcgaatggagtgagccgctgtggtgtcgcggcggcgcctacctagtggctttctcgcttcgcgtggaggcacccacgaccctcggtgacaacacagcagcgaacaacgtgcgcttccgctgttcagacggcgaggaactgcaggggcctgggctgagctggggagactttggagactggagtgaccattgccccaagggcgcgtgcggcctgcagaccaagatccagggacctagaggcctcggcgatgacactgcgctgaacgacgcgcgcttattctgctgccgcagttgaacggcgccgccgccgccgctctctcccgggccaggaggctagtcccacctcttgctattaaagcttctctgagttg

SEQ ID NO: 368 - protein, 202 aa, Homo sapiens
MERGAGAKLLPLLLLLRATGFTCAQTDGRNGYTAVIEVTSGGPWGDWAWPEMCPDGFFASGFSLKVEPPQGIPGDDTALNGIRLHCARGNVLGNTHVVESQSGSWGEWSEPLWCRGGAYLVAFSLRVEAPTTLGDNTAANNVRFRCSDGEELQGPGLSWGDFGDWSDHCPKGACGLQTKIQGPRGLGDDTALNDARLFCCRS

SEQ ID NO: 369 - DNA, 1030 bp, Homo sapiens
gccaacactggccaaacctcggagaccgtcctgcgctctctggagacgcgctgtccgcgcccagggtggtgccatgtggggcgctcgccgctcgtccgtctcctcatcctggaacgccgcttcgctcctgcagctgctgctggctgcgctgctggcggcgggggcgagggccagcggcgagtactgccacggctggctggacgcgcagggcgtctggcgcatcggcttccagtgtcccgagcgcttcgacggcggcgacgccaccatctgctgcggcagctgcgcgttgcgctactgctgctccagcgccgaggcgcgcctggaccagggcggctgcgacaatgaccgccagcagggcgctggcgagcctggccgggcggacaaagacggccccgacggctcggcagtgcccatctacgtgccgttcctcattgttggctccgtgtttgtcgcctttatcatcttggggtccctggtggcagcctgttgctgcagatgtctccggcctaagcaggatccccagcagagccgagccccagggggtaaccgcttgatggagaccatccccatgatccccagtgccagcacctcccgggggtcgtcctcacgccagtccagcacagctgccagttccagctccagcgccaactcaggggcccgggcgcccccaacaaggtcacagaccaactgttgcttgccggaagggaccatgaacaacgtgtatgtcaacatgcccacgaatttctctgtgctgaactgtcagcaggccacccagattgtgccacatcaagggcagtatctgcatcccccatacgtggggtacacggtgcagcacgactctgtgcccatgacagctgtgccacctttcatggacggcctgcagcctggctacaggcagattcagtcccccttccctcacaccaacagtgaacagaagatgtacccagcggtgactgtataaccgagagtcactggtgggttcctttactgaagggagacgaaggcaggggtggattttcgaggtggaagt

SEQ ID NO: 370 - protein, 295 aa, Homo sapiens
MWGARRSSVSSSWNAASLLQLLLAALLAAGARASGEYCHGWLDAQGVWRIGFQCPERFDGGDATICCGSCALRYCCSSAEARLDQGGCDNDRQQGAGEPGRADKDGPDGSAVPIYVPFLIVGSVFVAFIILGSLVAACCCRCLRPKQDPQQSRAPGGNRLMETIPMIPSASTSRGSSSRQSSTAASSSSSANSGARAPPTRSQTNCCLPEGTMNNVYVNMPTNFSVLNCQQATQIVPHQGQYLHPPYVGYTVQHDSVPMTAVPPFMDGLQPGYRQIQSPFPHTNSEQKMYPAVTV

SEQ ID NO: 371 - DNA, 2445 bp, Homo sapiens
  unsure 2424: unknown base
caccagacagcactccagcactctgtttggggggcattcgaaacagcaaaatcactcataaaaggcaaaaaattgcaaaaaaaaatagtaataaccagcatggcactaaatagaccatgaaaagacatgtgtgtgcagtatgaaaattgagacaggaaggcagagtgtcagcttgttccacctcagctgggaatgtgcatcaggcaactcaagtttttcaccacggcatgtgtctgtgaatgtccgcaaaacattctctctccccagccttcatgtgttaacctggggatgatgtggacctgggcactgtggatgctcccttcactctgcaaattcagcctggcagctctgccagctaagcctgagaacatttcctgtgtctactactataggaaaaatttaacctgcacttggagtccaggaaaggaaaccagttatacccagtacacagttaagagaacttacgcttttggagaaaaacatgataattgtacaaccaatagttctacaagtgaaaatcgtgcttcgtgctcttttttccttccaagaataacgatcccagataattataccattgaggtggaagctgaaaatggagatggtgtaattaaatctcatatgacatactggagattagagaacatagcgaaaactgaaccacctaagattttccgtgtgaaaccagttttgggcatcaaacgaatgattcaaattgaatggataaagcctgagttggcgcctgtttcatctgatttaaaatacacacttcgattcaggacagtcaacagtaccagctggatggaagtcaacttcgctaagaaccgtaaggataaaaaccaaacgtacaacctcacggggctgcagccttttacagaatatgtcatagctctgcgatgtgcggtcaaggagtcaaagttctggagtgactggagccaagaaaaaatgggaatgactgaggaagaagctccatgtggcctggaactgtggagagtcctgaaaccagctgaggcggatggaagaaggccagtgcggttgttatggaagaaggcaagaggagccccagtcctagagaaaacacttggctacaacatatggtactatccagaaagcaacactaacctcacagaaacaatgaacactactaaccagcagcttgaactgcatctgggaggcgagagcttttgggtgtctatgatttcttataattctcttgggaagtctccagtggccaccctgaggattccagctattcaagaaaaatcatttcagtgcattgaggtcatgcaggcctgcgttgctgaggaccagctagtggtgaagtggcaaagctctgctctagacgtgaacacttggatgattgaatggtttccggatgtggactcagagcccaccaccctttcctgggaatctgtgtctcaggccacgaactggacgatccagcaagataaattaaaacctttctggtgctataacatctctgtgtatccaatgttgcatgacaaagttggcgagccatattccatccaggcttatgccaaagaaggcgttccatcagaaggtcctgagaccaaggtggagaacattggcgtgaagacggtcacgatcacatggaaagagattcccaagagtgagagaaagggtatcatctgcaactacaccatcttttaccaagctgaaggtggaaaaggattctgtaagcacgcccatagcgaagtggaaaaaaaccccaagccccagatagatgctatggatagacctgttgtaggcatggctcccccatctcattgtgacttgcaacctggcatgaatcacttagcttctttaaatctctctgaaaatggggccaagagcacccaccttttggggttttgggggttaaatgagagtgaagtgacagtacctgagaggagagtcctgaggaaatggaaggagttgttataatttgtcctggttaggccctgaattgacctcccgggagctccccgaccatcattcccaggaatggcgtgcctggcttaaagagtgaggaggaacagaccctgtcaccatgacttctactgcccctgccaaatcatgcttttgtttttcagtccaccttatctcctgacatcttaaatactgggcaaggcttggattcttgcttaggctaaataattttttcttatggtaaaatacacgtaaaatatttttccagtttaaacatttgaaagtgtacaatttagtggcattagaagcattcacaatattgtgcaaccatcaccactatttccagaactcttctatttctgcccaaatagaagccctatacccattcattagtcactccccattcctctcctcccacagcccctggcaactaccaaactgctttgtgtctctatggattgcctattttggatatttcatatacatagaatcataaantaaaaaaaaaaaaaaaaaaaa

SEQ ID NO: 372 - protein, 582 aa, Homo sapiens
MCIRQLKFFTTACVCECPQNILSPQPSCVNLGMMWTWALWMLPSLCKFSLAALPAKPENISCVYYYRKNLTCTWSPGKETSYTQYTVKRTYAFGEKHDNCTTNSSTSENRASCSFFLPRITIPDNYTIEVEAENGDGVIKSHMTYWRLENIAKTEPPKIFRVKPVLGIKRMIQIEWIKPELAPVSSDLKYTLRFRTVNSTSWMEVNFAKNRKDKNQTYNLTGLQPFTEYVIALRCAVKESKFWSDWSQEKMGMTEEEAPCGLELWRVLKPAEADGRRPVRLLWKKARGAPVLEKTLGYNIWYYPESNTNLTETMNTTNQQLELHLGGESFWVSMISYNSLGKSPVATLRIPAIQEKSFQCIEVMQACVAEDQLVVKWQSSALDVNTWMIEWFPDVDSEPTTLSWESVSQATNWTIQQDKLKPFWCYNISVYPMLHDKVGEPYSIQAYAKEGVPSEGPETKVENIGVKTVTITWKEIPKSERKGIICNYTIFYQAEGGKGFCKHAHSEVEKNPKPQIDAMDRPVVGMAPPSHCDLQPGMNHLASLNLSENGAKSTHLLGFWGLNESEVTVPERRVLRKWKELL

SEQ ID NO: 373 - DNA, 1743 bp, Homo sapiens
ccaggtccaactgcacctcggttctatcgattgaattccccggggatcctctagagatccctcgacctcgacccacgcgtccgccaagctggccctgcacggctgcaagggaggctcctgtggacaggccaggcaggtgggcctcaggaggtgcctccaggcggccagtgggcctgaggccccagcaagggctagggtccatctccagtcccaggacacagcagcggccaccatggccacgcctgggctccagcagcatcagcagcccccaggaccgggggaggcacaggtggcccccaccacccggaggagcagctcctgcccctgtccgggggatgactgattctcctccgccaggccacccagaggagaaggccaccccgcctggaggcacaggccatgaggggctctcaggaggtgctgctgatgtggcttctggtgttggcagtgggcggcacagagcacgcctaccggcccggccgttagggtgtgtgctgtcccgggctcacggggaccctgtctccgagtcgttcgtgcagcgtgtgtaccagcccttcctcaccacctgcgacgggcaccgggcctgcagcacctaccgaaccatttataggaccgcctaccgccgcagccctgggctggcccctgccaggcctcgctacgcgtgctgccccggctggaagaggaccagcgggcttcctggggcctgtggagcagcaatatgccagccgccatgccggaacggagggagctgtgtccagcctggccgctgccgctgccctgcaggatggcggggtgacacttgccagtcagatgtggatgaatgcagtgctaggaggggcggctgtccccagcgctgcatcaacaccgccggcagttactggtgccagtgttgggaggggcacagcctgtctgcagacggtacactctgtgtgcccaagggagggccccccagggtggcccccaacccgacaggagtggacagtgcaatgaaggaagaagtgcagaggctgcagtccagggtggacctgctggaggagaagctgcagctggtgctggccccactgcacagcctggcctcgcaggcactggagcatgggctcccggaccccggcagcctcctggtgcactccttccagcagctcggccgcatcgactccctgagcgagcagatttccttcctggaggagcagctggggtcctgctcctgcaagaaagactcgtgactgcccagcgccccaggctggactgagcccctcacgccgccctgcagcccccatgcccctgcccaacatgctgggggtccagaagccacctcggggtgactgagcggaaggccaggcagggccttcctccttttcctcctccccttccctcgggagggtccccagaccctggcatgggatgggctgggattttttttgtgaatccacccctggctacccccaccctggttaccccaacggcatcccaaggccaggtgggccctcagctgagggaaggtacgagttcccctgctggagcctgggacccatggcacaggccaggcagcccggaggctgggtggggcctcagtgggggctgctgcctgacccccagcacaataaaaatgaaacgtgaaaaaaaaaaaaaaaaaaaaaaaaaaaaaaaaaaaaaaaaaagggcggccgcgactctagagtcgacctgcagaagcttggccgccatggcccaacttgtttattgcagcttataatggttacaaat

SEQ ID NO: 374 - protein, 295 aa, Homo sapiens
MTDSPPPGHPEEKATPPGGTGHEGLSGGAADVASGVGSGRHRARLPARPLGCVLSRAHGDPVSESFVQRVYQPFLTTCDGHRACSTYRTIYRTAYRRSPGLAPARPRYACCPGWKRTSGLPGACGAAICQPPCRNGGSCVQPGRCRCPAGWRGDTCQSDVDECSARRGGCPQRCINTAGSYWCQCWEGHSLSADGTLCVPKGGPPRVAPNPTGVDSAMKEEVQRLQSRVDLLEEKLQLVLAPLHSLASQALEHGLPDPGSLLVHSFQQLGRIDSLSEQISFLEEQLGSCSCKKDS

SEQ ID NO: 375 - DNA, 48 bp, Artificial Sequence
  Primer_Bind
ggattctaatacgactcactatagggccgggtggaggtggaacagaaa

SEQ ID NO: 376 - DNA, 48 bp, Artificial Sequence
  Primer_Bind
ctatgaaattaaccctcactaaagggacacagacagagccccatacgc

SEQ ID NO: 377 - DNA, 47 bp, Artificial Sequence
  Primer_Bind
ggattctaatacgactcactatagggccagggaaatccggatgtctc

SEQ ID NO: 378 - DNA, 48 bp, Artificial Sequence
  Primer_Bind
ctatgaaattaaccctcactaaagggagtaaggggatgccaccgagta

SEQ ID NO: 379 - DNA, 47 bp, Artificial Sequence
  Primer_Bind
ggattctaatacgactcactatagggccagctacccgcaggaggagg

SEQ ID NO: 380 - DNA, 48 bp, Artificial Sequence
  Primer_Bind
ctatgaaattaaccctcactaaagggatcccaggtgatgaggtccaga

SEQ ID NO: 381 - DNA, 468 bp, Homo sapiens
ccatctcggagacctttgtgcagcgtgtataccagccttacctcaccacttgcgacggacacagagcctgcagcacctaccgaaccatctaccggactgcctatcgccgtagccctggggtgactcccgcaagcctcgctatgcttgctgccctggttggaagaggaccagtgggctccctggggcttgtggagcagcaatatgccagcctccatgtgggaatggagggagttgcatccgcccaggacactgccgctgccctgtgggatggcagggagatacttgccagacagatgttgatgaatgcagtacaggagaggccagttgtccccagcgctgtgtcaatactgtgggaagttactggtgccagggatgggagggacaaagcccatctgcagatgggacgcgctgcctgtctaaggaggggccctcccggtggccccaaccccacagcaggagtggacagca

SEQ ID NO: 382 - DNA, 43 bp, Artificial Sequence
  Primer_Bind
tgtaaaacgacggccagttaaatagacctgcaattattaatct

SEQ ID NO: 383 - DNA, 41 bp, Artificial Sequence
  Primer_Bind
caggaaacagctatgaccacctgcacacctgcaaatccatt

What is claimed is:

1. An isolated nucleic acid encoding polypeptide having at least 95% sequence identity to:
   (a) the amino acid sequence of the polypeptide of SEQ ID NO:346;
   (b) the amino acid sequence of the polypeptide of SEQ ID NO:346, lacking its associated signal peptide;
   (c) the amino acid sequence of the polypeptide encoded by the full-length coding sequence of the nucleic acid sequence of SEQ ID NO:345; or
   (d) the amino acid sequence of the polypeptide encoded by the full-length coding sequence of the cDNA deposited under ATCC accession number 863-PTA,
   wherein the encoded polypeptide stimulates human iliac artery endothelial cell proliferation.

2. The isolated nucleic acid of claim 1 encoding a polypeptide having at least 99% sequence identity to:
   (a) the amino acid sequence of the polypeptide of SEQ ID NO:346;
   (b) the amino acid sequence of the polypeptide of SEQ ID NO:346, lacking its associated signal peptide;
   (c) the amino acid sequence of the polypeptide encoded by the full-length coding sequence of the nucleic acid sequence of SEQ ID NO:345; or
   (d) the amino acid sequence of the polypeptide encoded by the full-length coding sequence of the cDNA deposited under ATCC accession number 863-PTA,
   wherein the encoded polypeptide stimulates human iliac artery endothelial cell proliferation.

3. An isolated nucleic acid comprising:
   (a) a nucleic acid sequence encoding the polypeptide of SEQ ID NO:346;
   (b) a nucleic acid sequence encoding the polypeptide of SEQ ID NO:346, lacking its associated signal peptide;
   (c) the nucleic acid sequence of SEQ ID NO:345;
   (d) the full-length coding sequence of the nucleic acid sequence of SEQ ID NO:345; or (e) the full-length coding sequence of the cDNA deposited under ATCC accession number 863-PTA.

4. The isolated nucleic acid of claim 3 comprising a nucleic acid sequence encoding the polypeptide of SEQ ID NO:346.

5. The isolated nucleic acid of claim 3 comprising a nucleic acid sequence encoding the polypeptide of SEQ ID NO:346, lacking its associated signal peptide.

6. The isolated nucleic acid of claim 3 comprising the nucleic acid sequence of SEQ ID NO:345.

7. The isolated nucleic acid of claim 3 comprising the full-length coding sequence of the nucleic acid sequence of SEQ ID NO:345.

8. The isolated nucleic acid of claim 3 comprising the full-length coding sequence of the cDNA deposited under ATCC accession number 863-PTA.

9. A vector comprising the nucleic acid of claim 1.

10. The vector of claim 9, wherein said nucleic acid is operably linked to control sequences recognized by an isolated host cell transformed with the vector.

11. An isolated host cell comprising the vector of claim 10.

12. The isolated host cell of claim 11, wherein said cell is a CHO cell, an *E. coli* or a yeast cell.

13. An isolated nucleic acid molecule consisting of an at least 30 nucleotide fragment of the nucleic acid sequence of SEQ ID NO:345, or the complement thereof that specifically hybridizes under stringent conditions to:

(a) the nucleic acid sequence of SEQ ID NO:345 or the complement thereof;

(b) the full-length coding sequence of the cDNA deposited under ATCC accession number 863-PTA or the complement thereof;

wherein said stringent conditions consist of 50% formamide, 5×SSC, 50 mM sodium phosphate (pH 6.8), 0.1% sodium pyrophosphate, 5× Denhardt's solution, sonicated salmon sperm DNA (50 µg/ml), 0.1% SDS, and 10% dextran sulfate at 42° C., with washes at 42° C. in 0.2×SSC and 50% formamide at 55° C., followed by a wash comprising of 0.1×SSC containing EDTA at 55° C., wherein said isolated nucleic acid molecule is suitable for use as a primer or probe.

14. The isolated nucleic acid molecule of claim 13 that is at least 50 nucleotides in length.

15. The isolated nucleic acid molecule of claim 13 that is at least 60 nucleotides in length.

16. The isolated nucleic acid molecule of claim 13 that is at least 70 nucleotides in length.

17. The isolated nucleic acid molecule of claim 13 that is at least 80 nucleotides in length.

18. The isolated nucleic acid molecule of claim 13 that is at least 90 nucleotides in length.

19. The isolated nucleic acid molecule of claim 13 that is at least 100 nucleotides in length.

* * * * *